(12) United States Patent
Halperin

(10) Patent No.: US 12,415,993 B2
(45) Date of Patent: *Sep. 16, 2025

(54) RNA-GUIDED ENDONUCLEASE FUSION POLYPEPTIDES AND METHODS OF USE THEREOF

(71) Applicant: The Regents of the University of California, Oakland, CA (US)

(72) Inventor: Schaked Omer Halperin, Berkeley, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/130,199

(22) Filed: Apr. 3, 2023

(65) Prior Publication Data

US 2023/0399630 A1    Dec. 14, 2023

Related U.S. Application Data

(62) Division of application No. 16/641,950, filed as application No. PCT/US2018/049766 on Sep. 6, 2018, now Pat. No. 11,649,442.

(60) Provisional application No. 62/662,043, filed on Apr. 24, 2018, provisional application No. 62/556,127, filed on Sep. 8, 2017.

(51) Int. Cl.
| | | |
|---|---|---|
| C12N 9/22 | (2006.01) | |
| C12N 9/12 | (2006.01) | |
| C12N 9/78 | (2006.01) | |
| C12N 15/10 | (2006.01) | |
| C12N 15/11 | (2006.01) | |

(52) U.S. Cl.
CPC ............ *C12N 9/22* (2013.01); *C12N 9/1252* (2013.01); *C12N 9/78* (2013.01); *C12N 15/1024* (2013.01); *C12N 15/11* (2013.01); *C12Y 207/07007* (2013.01); *C12Y 305/04004* (2013.01); *C12Y 305/04005* (2013.01); *C12N 2800/80* (2013.01)

(58) Field of Classification Search
None
See application file for complete search history.

(56) References Cited

U.S. PATENT DOCUMENTS

| | | |
|---|---|---|
| 9,161,995 B2 | 10/2015 | Guschin et al. |
| 10,752,920 B2 | 8/2020 | Doudna et al. |
| 11,193,123 B2 | 12/2021 | Halperin |
| 2002/0192788 A1 | 12/2002 | Ihlenfeldt et al. |
| 2014/0010839 A1 | 1/2014 | Benkirane et al. |
| 2015/0044772 A1 | 2/2015 | Zhao |
| 2015/0166980 A1 | 6/2015 | Liu et al. |
| 2016/0160193 A1 | 6/2016 | Hsieh et al. |
| 2017/0058271 A1 | 3/2017 | Joung et al. |
| 2017/0121693 A1 | 5/2017 | Liu et al. |
| 2018/0073012 A1 | 3/2018 | Liu et al. |
| 2018/0230494 A1 | 8/2018 | Joung et al. |
| 2018/0237770 A1 | 8/2018 | May et al. |
| 2018/0298414 A1 | 10/2018 | Janulaitis et al. |
| 2018/0313843 A1 | 11/2018 | Keppler et al. |
| 2019/0062409 A1 | 2/2019 | Luban |
| 2019/0350978 A1 | 11/2019 | Beauchesne et al. |
| 2020/0038424 A1 | 2/2020 | Hirano et al. |
| 2020/0248155 A1 | 8/2020 | Halperin |

FOREIGN PATENT DOCUMENTS

| | | |
|---|---|---|
| WO | WO 2011/116184 | 9/2011 |
| WO | WO 2014/186686 | 11/2014 |
| WO | WO 2016/028843 | 2/2016 |
| WO | WO 2016/036754 | 3/2016 |
| WO | WO 2016/183448 | 11/2016 |
| WO | WO 2016/196805 | 12/2016 |
| WO | WO 2017/106616 | 6/2017 |
| WO | WO 2017/151719 | 9/2017 |
| WO | WO 2017/189308 | 11/2017 |
| WO | WO 2018/049168 | 3/2018 |
| WO | WO 2018/165629 | 9/2018 |
| WO | WO 2018/176009 | 9/2018 |
| WO | WO 2018/027078 | 12/2018 |
| WO | WO 2019/051097 | 3/2019 |
| WO | WO 2019/070842 | 4/2019 |
| WO | WO 2019/070843 | 4/2019 |
| WO | WO 2020/012335 | 1/2020 |
| WO | WO 2015/035139 | 3/2020 |
| WO | WO 2020/047124 | 3/2020 |
| WO | WO 2020/051561 | 3/2020 |
| WO | WO 2020/191153 | 9/2020 |
| WO | WO 2020/191171 | 9/2020 |
| WO | WO 2020/191233 | 9/2020 |
| WO | WO 2020/191234 | 9/2020 |
| WO | WO 2020/191239 | 9/2020 |
| WO | WO 2020/191241 | 9/2020 |
| WO | WO 2020/191242 | 9/2020 |
| WO | WO 2020/191243 | 9/2020 |
| WO | WO 2020/191245 | 9/2020 |
| WO | WO 2020/191246 | 9/2020 |
| WO | WO 2020/191248 | 9/2020 |
| WO | WO 2020/191249 | 9/2020 |
| WO | WO 2021/188840 | 9/2021 |

OTHER PUBLICATIONS

Antczak, et al. New functionality of RNAComposer: application to shape the axis of miR160 precursor structure. Acta Biochim. Pol. 63, 737-744 (2016).

(Continued)

*Primary Examiner* — Suzanne M Noakes
(74) *Attorney, Agent, or Firm* — James J. Diehl; Bozicevic, Field & Francis LLP

(57) ABSTRACT

The present disclosure provides a fusion polypeptide comprising: a) an enzymatically active RNA-guided endonuclease that introduces a single-stranded break in a target DNA; and b) an error-prone DNA polymerase. The present disclosure provides a system comprising: a) a fusion polypeptide of the present disclosure; and b) a guide RNA. The present disclosure provides a cell comprising a fusion polypeptide of the present disclosure, or a system of the present disclosure. The present disclosure provides a method of mutagenizing a target polynucleotide.

27 Claims, 70 Drawing Sheets

Specification includes a Sequence Listing.

(56) References Cited

OTHER PUBLICATIONS

Anzalone, et al. Search-and-replace genome editing without double-strand breaks or donor DNA. Nature 576, 149-157 (2019).
Bajaj, et al. An in vivo genome-wide CRISPR screen identifies the RNA-binding protein Staufen2 as a key regulator of myeloid leukemia. Nature Cancer vol. 1 410-422 (2020).
Christensen, et al. Footprint of the retrotransposon R2Bm protein on its target site before and after cleavage. Journal of molecular biology vol. 336,5 (2004): 1035-45.
Co-pending U.S. Appl. No. 17/206,522, inventor Halperin; Schaked Omer, filed Mar. 19, 2021.
Co-pending U.S. Appl. No. 17/206,526, inventor Halperin; Schaked Omer, filed Mar. 19, 2021.
Co-pending U.S. Appl. No. 17/340,822, inventor Halperin; Schaked, filed Jun. 7, 2021.
Co-pending U.S. Appl. No. 17/506,419, inventors Halperin; Schaked Omer et al., filed Oct. 20, 2021.
Cox, et al. Therapeutic genome editing: prospects and challenges. Nature Medicine vol. 21 121-131 (2015).
Denli, et al. Primate-Specific ORF0 Contributes to Retrotransposon-Mediated Diversity, Cell, vol. 163, 3:1 (2015): 583-593.
Gaudelli, et al. Programmable base editing of A•T to G•C in genomic DNA without DNA cleavage. Nature 551, 464-471 (2017).
Grünewald, et al. Transcriptome-wide off-target RNA editing induced by CRISPR-guided DNA base editors. Nature 569, 433-437 (2019).
Guilinger, et al.; "Fusion of catalytically inactive Cas9 to FokI nuclease improves the specificity of genome modification"; Nat. Biotechnol.; vol. 32, No. 6, pp. 577-582 (Jun. 2014).
Haapaniemi, et al. CRISPR-Cas9 genome editing induces a p53-mediated DNA damage response. Nat. Med. 24, 927-930 (2018).
Halperin, et al.; "CRISPR-guided DNA polymerases enable diversification of all nucleotides in a tunable window"; Nature; vol. 560, pp. 248-252 (Aug. 1, 2018).
Hrecka, et al. Vpx relieves inhibition of HIV-1 infection of macrophages mediated by the SAMHD1 protein. Nature 474, 658-661 (2011).
Ihry, et al. p53 inhibits CRISPR-Cas9 engineering in human pluripotent stem cells. Nat. Med. 24, 939-946 (2018).
Jinek, et al. A programmable dual-RNA-guided DNA endonuclease in adaptive bacterial immunity. Science 337, 816-821 (2012).
Komor, et al. Programmable editing of a target base in genomic DNA without double-stranded DNA cleavage. Nature 533, 420-424 (2016).
Krzywkowski, et al. Limited reverse transcriptase activity of phi29 DNA polymerase. Nucleic acids research vol. 46,7 (2018): 3625-3632.
Ledford, H. CRISPR Editing Wreaks Chromosomal Mayhem in Human Embryos. Nature. vol. 583. (Jul. 2, 2020): 17-18.
Ledford, H. CRISPR gene editing in human embryos wreaks chromosomal mayhem. Nature 583, 17-18 (2020).
Lemmon, et al. Rapid improvement of domestication traits in an orphan crop by genome editing. Nature Plants vol. 4 766-770 (2018).
Maeder, et al. Development of a gene-editing approach to restore vision loss in Leber congenital amaurosis type 10. Nat. Med. 25, 229-233 (2019).
Mali, et al. RNA-guided human genome engineering via Cas9. Science 339, 823-826 (2013).
Middleton, et al. Elexacaftor-Tezacaftor-Ivacaftor for Cystic Fibrosis with a Single Phe508del Allele. New England Journal of Medicine vol. 381 1809-1819 (2019).
Ostedgaard, et al. CFTR with a partially deleted R domain corrects the cystic fibrosis chloride transport defect in human airway epithelia in vitro and in mouse nasal mucosa in vivo. Proc. Natl. Acad. Sci. U. S. A. 99, 3093-3098 (2002).
Palikša, et al. Decreased Km to dNTPs is an essential M-MuLV reverse transcriptase adoption required to perform efficient cDNA synthesis in One-Step RT-PCR assay. Protein Eng. Des. Sel. 31, 79-89 (2018).
PCT Application No. PCT/US21/23041 International Search Report and Written Opinion dated Jul. 13, 2021.
Ribeiro, et al. Protein Engineering Strategies to Expand CRISPR-Cas9 Applications. International Journal of Genomics, vol. 2018, Aug. 2, 2018, pp. 1-12.
Silas, et al. Direct CRISPR spacer acquisition from RNA by a natural reverse transcriptase-Cas1 fusion protein. Science, New York, N.Y., vol. 351, issue 6276, Feb. 26, 2016.
St Gelais, et al.; "SAMHD1 restricts HIV-1 infection in dendritic cells (DCs) by dNTP depletion, but its expression in DCs and primary CD4+ T-lymphocytes cannot be upregulated by interferons"; Retrovirology; vol. 9, No. 105, 15 pages (2012).
Su, et al. Human DNA polymerase nhas reverse transcriptase activity in cellular environments. The Journal of biological chemistry vol. 294, 15 (2019): 6073-6081.
Toro, et al. The Reverse Transcriptases Associated with CRISPR-Cas Systems. Scientific reports, | vol. 7, issue 7089, Aug. 2, 2017.
U.S. Appl. No. 17/206,522 Examiner's Interview Summary dated Sep. 30, 2021.
U.S. Appl. No. 17/206,522 Final Office Action dated Sep. 15, 2021.
U.S. Appl. No. 17/206,522 Notice of Allowance dated Oct. 12, 2021.
U.S. Appl. No. 17/206,522 Office Action dated Jul. 22, 2021.
U.S. Appl. No. 17/206,526 Office Action dated Sep. 2, 2021.
Xie, et al. Effective and accurate gene silencing by a recombinant AAV-compatible microRNA scaffold. Molecular Therapy 28.2 (2020): 422-430.
Yan, et al. CyclinA2-Cyclin-dependent Kinase Regulates SAMHD1 Protein Phosphohydrolase Domain. Journal of Biological Chemistry vol. 290 13279-13292 (2015).
Yang, et al.; "Amino Acid Changes in a Unique Sequence of Bacteriophage T7 DNA Polymerase Alter the Processivity of Nucleotide Polymerization"; The Journal of Biological Chemistry; vol. 272, No. 10, pp. 6599-6606 (1997).
Yu, et al. The efficiency of Vpx-mediated SAMHD1 antagonism does not correlate with the potency of viral control in HIV-2-infected individuals. Retrovirology 10, 27 (2013).
Zhang, et al.; "Conserved Herpesvirus Protein Kinases Target SAMHD1 to Facilitate Virus Replication"; Cell Reports; vol. 27, pp. 449-459 (Jul. 9, 2019).
Zuo, et al. Cytosine base editor generates substantial off-target single-nucleotide variants in mouse embryos. Science 364, 289-292 (2019).

FIG. 5A

*Streptococcus pyogenes* Cas9

MDKKYSIGLDIGTNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEKMDGTEELLVKLNREDLLRKQRTFDNGSIPHQIH
LGELHAILRRQEDFYPFLKDNREKIEKILTFRIPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKAIVDLLFKTNRKVTVKQLKEDYFKKIECFDSVEI
SGVEDRFNASLGTYHDLLKIIKDKDFLDNEENEDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVSGQGDSLHEHIANLAGSPAIKKGILQTVKVVDE
LVKVMGRHKPENIVIEMARENQTTQKGQKNSRERMKRIEEGIKELGSQILKEHPVENTQLQNEKLYLYYLQNGRDMYVDQ
ELDINRLSDYDVDHIVPQSFLKDDSIDNKVLTRSDKNRGKSDNVPSEEVVKKMKNYWRQLLNAKLITQRKFDNLTKAERGG
LSELDKAGFIKRQLVETRQITKHVAQILDSRMNTKYDENDKLIREVKVITLKSKLVSDFRKDFQFYKVREINNYHHAHDAYLN
AVVGTALIKKYPKLESEFVYGDYKVYDVRKMIAKSEQEIGKATAKYFFYSNIMNFFKTEITLANGEIRKRPLIETNGETGEIVW
DKGRDFATVRKVLSMPQVNIVKKTEVQTGGFSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLFELENGRKRMLASAGELQKGNELALPSKYVNFLYL
ASHYEKLKGSPEDNEQKQLFVEQHKHYLDEIIEQISEFSKRVILADANLDKVLSAYNKHRDKPIREQAENIIHLFTLTNLGAPA
AFKYFDTTIDRKRYTSTKEVLDATLIHQSITGLYETRIDLSQLGGD

FIG. 5B

>nSpCas9 (SpCas9 D10A)

MDKKYSIGLAIGTNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEKMDGTEELLVKLNREDLLRKQRTFDNGSIPHQIHL
GELHAILRRQEDFYPFLKDNREKIEKILTFRIPYYVGPLARGNSRFAWMTRKSEETITPWNFEEVVDKGASAQSFIERMTNFD
KNLPNEKVLPKHSLLYEYFTVYNELTKVKYVTEGMRKPAFLSGEQKKAIVDLLFKTNRKVTVKQLKEDYFKKIECFDSVEIS
GVEDRFNASLGTYHDLLKIIKDKDFLDNEENEDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVSGQGDSLHEHIANLAGSPAIKKGILQTVKVVDE
LVKVMGRHKPENIVIEMARENQTTQKGQKNSRERMKRIEEGIKELGSQILKEHPVENTQLQNEKLYLYYLQNGRDMYVDQE
LDINRLSDYDVDHIVPQSFLKDDSIDNKVLTRSDKNRGKSDNVPSEEVVKKMKNYWRQLLNAKLITQRKFDNLTKAERGGL
SELDKAGFIKRQLVETRQITKHVAQILDSRMNTKYDENDKLIREVKVITLKSKLVSDFRKDFQFYKVREINNYHHAHDAYLN
AVVGTALIKKYPKLESEFVYGDYKVYDVRKMIAKSEQEIGKATAKYFFYSNIMNFFKTEITLANGEIRKRPLIETNGETGEIV
WDKGRDFATVRKVLSMPQVNIVKKTEVQTGGFSKESILPKRNSDKLIARKKDWDPKKYGGFDSPTVAYSVLVVAKVEKGK
SKKLKSVKELLGITIMERSSFEKNPIDFLEAKGYKEVKKDLIIKLPKYSLFELENGRKRMLASAGELQKGNELALPSKYVNFLY
LASHYEKLKGSPEDNEQKQLFVEQHKHYLDEIIEQISEFSKRVILADANLDKVLSAYNKHRDKPIREQAENIIHLFTLTNLGAP
AAFKYFDTTIDRKRYTSTKEVLDATLIHQSITGLYETRIDLSQLGGD

FIG. 5C

SpCas9 (H840A)

MDKKYSIGLDIGTNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEKMDGTEELLVKLNREDLLRKQRTFDNGSIPHQIH
LGELHAILRRQEDFYPFLKDNREKIEKILTFRIPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKAIVDLLFKTNRKVTVKQLKEDYFKKIECFDSVEI
SGVEDRFNASLGTYHDLLKIIKDKDFLDNEENEDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVSGQGDSLHEHIANLAGSPAIKKGILQTVKVVDE
LVKVMGRHKPENIVIEMARENQTTQKGQKNSRERMKRIEEGIKELGSQILKEHPVENTQLQNEKLYLYYLQNGRDMYVDQ
ELDINRLSDYDVDAIVPQSFLKDDSIDNKVLTRSDKNRGKSDNVPSEEVVKKMKNYWRQLLNAKLITQRKFDNLTKAERGG
LSELDKAGFIKRQLVETRQITKHVAQILDSRMNTKYDENDKLIREVKVITLKSKLVSDFRKDFQFYKVREINNYHHAHDAYLN
AVVGTALIKKYPKLESEFVYGDYKVYDVRKMIAKSEQEIGKATAKYFFYSNIMNFFKTEITLANGEIRKRPLIETNGETGEIVW
DKGRDFATVRKVLSMPQVNIVKKTEVQTGGFSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLFELENGRKRMLASAGELQKGNELALPSKYVNFLYL
ASHYEKLKGSPEDNEQKQLFVEQHKHYLDEIIEQISEFSKRVILADANLDKVLSAYNKHRDKPIREQAENIIHLFTLTNLGAPA
AFKYFDTTIDRKRYTSTKEVLDATLIHQSITGLYETRIDLSQLGGD

FIG. 5D

SpCas9 (D10A; H840A)

MDKKYSIGLAIGTNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEKMDGTEELLVKLNREDLLRKQRTFDNGSIPHQIH
LGELHAILRRQEDFYPFLKDNREKIEKILTFRIPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKAIVDLLFKTNRKVTVKQLKEDYFKKIECFDSVEI
SGVEDRFNASLGTYHDLLKIIKDKDFLDNEENEDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVSGQGDSLHEHIANLAGSPAIKKGILQTVKVVDE
LVKVMGRHKPENIVIEMARENQTTQKGQKNSRERMKRIEEGIKELGSQILKEHPVENTQLQNEKLYLYYLQNGRDMYVDQ
ELDINRLSDYDVDAIVPQSFLKDDSIDNKVLTRSDKNRGKSDNVPSEEVVKKMKNYWRQLLNAKLITQRKFDNLTKAERGG
LSELDKAGFIKRQLVETRQITKHVAQILDSRMNTKYDENDKLIREVKVITLKSKLVSDFRKDFQFYKVREINNYHHAHDAYLN
AVVGTALIKKYPKLESEFVYGDYKVYDVRKMIAKSEQEIGKATAKYFFYSNIMNFFKTEITLANGEIRKRPLIETNGETGEIVW
DKGRDFATVRKVLSMPQVNIVKKTEVQTGGFSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLFELENGRKRMLASAGELQKGNELALPSKYVNFLYL
ASHYEKLKGSPEDNEQKQLFVEQHKHYLDEIIEQISEFSKRVILADANLDKVLSAYNKHRDKPIREQAENIIHLFTLTNLGAPA
AFKYFDTTIDRKRYTSTKEVLDATLIHQSITGLYETRIDLSQLGGD

FIG. 5E

>enSpCas9 (nCas9 with K848A/K1003A/R1060A mutations
Slaymaker, Ian M., et al. "Rationally engineered Cas9 nucleases with improved specificity." Science 351.6268 (2016): 84-88.

MDKKYSIGLAIGTNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEKMDGTEELLVKLNREDLLRKQRTFDNGSIPHQIHL
GELHAILRRQEDFYPFLKDNREKIEKILTFRIPYYVGPLARGNSRFAWMTRKSEETITPWNFEEVVDKGASAQSFIERMTNFD
KNLPNEKVLPKHSLLYEYFTVYNELTKVKYVTEGMRKPAFLSGEQKKAIVDLLFKTNRKVTVKQLKEDYFKKIECFDSVEIS
GVEDRFNASLGTYHDLLKIIKDKDFLDNEENEDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVSGQGDSLHEHIANLAGSPAIKKGILQTVKVVDE
LVKVMGRHKPENIVIEMARENQTTQKGQKNSRERMKRIEEGIKELGSQILKEHPVENTQLQNEKLYLYYLQNGRDMYVDQE
LDINRLSDYDVDHIVPQSFLADDSIDNKVLTRSDKNRGKSDNVPSEEVVKKMKNYWRQLLNAKLITQRKFDNLTKAERGGL
SELDKAGFIKRQLVETRQITKHVAQILDSRMNTKYDENDKLIREVKVITLKSKLVSDFRKDFQFYKVREINNYHHAHDAYLN
AVVGTALIKKYPALESEFVYGDYKVYDVRKMIAKSEQEIGKATAKYFFYSNIMNFFKTEITLANGEIRKAPLIETNGETGEIV
WDKGRDFATVRKVLSMPQVNIVKKTEVQTGGFSKESILPKRNSDKLIARKKDWDPKKYGGFDSPTVAYSVLVVAKVEKGK
SKKLKSVKELLGITIMERSSFEKNPIDFLEAKGYKEVKKDLIIKLPKYSLFELENGRKRMLASAGELQKGNELALPSKYVNFLY
LASHYEKLKGSPEDNEQKQLFVEQHKHYLDEIIEQISEFSKRVILADANLDKVLSAYNKHRDKPIREQAENIIHLFTLTNLGAP
AAFKYFDTTIDRKRYTSTKEVLDATLIHQSITGLYETRIDLSQLGGD

FIG. 5F

>nSpCas9-HF1
Kleinstiver, Benjamin P., et al. "High-fidelity CRISPR-Cas9 variants with undetectable genome-wide off-targets." Nature 529.7587 (2016): 490.

DKKYSIGLAIGTNSVGWAVITDEYKVPSKKFKVLGNTDRHSIKKNLIGALLFDSGETAEATRLKRTARRRYTRRKNRICYLQE
IFSNEMAKVDDSFFHRLEESFLVEEDKKHERHPIFGNIVDEVAYHEKYPTIYHLRKKLVDSTDKADLRLIYLALAHMIKFRGH
FLIEGDLNPDNSDVDKLFIQLVQTYNQLFEENPINASGVDAKAILSARLSKSRRLENLIAQLPGEKKNGLFGNLIALSLGLTPNF
KSNFDLAEDAKLQLSKDTYDDDLDNLLAQIGDQYADLFLAAKNLSDAILLSDILRVNTEITKAPLSASMIKRYDEHHQDLTLL
KALVRQQLPEKYKEIFFDQSKNGYAGYIDGGASQEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRKSEETITPWNFEEVVDKGASAQSFIERMTAFDKN
LPNEKVLPKHSLLYEYFTVYNELTKVKYVTEGMRKPAFLSGEQKKAIVDLLFKTNRKVTVKQLKEDYFKKIECFDSVEISGV
EDRFNASLGTYHDLLKIIKDKDFLDNEENEDILEDIVLTLTLFEDREMIEERLKTYAHLFDDKVMKQLKRRRYTGWGALSRK
LINGIRDKQSGKTILDFLKSDGFANRNFMALIHDDSLTFKEDIQKAQVSGQGDSLHEHIANLAGSPAIKKGILQTVKVVDELV
KVMGRHKPENIVIEMARENQTTQKGQKNSRERMKRIEEGIKELGSQILKEHPVENTQLQNEKLYLYYLQNGRDMYVDQELD
INRLSDYDVDHIVPQSFLKDDSIDNKVLTRSDKNRGKSDNVPSEEVVKKMKNYWRQLLNAKLITQRKFDNLTKAERGGLSE
LDKAGFIKRQLVETRAITKHVAQILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFELENGRKRMLASAGELQKGNELALPSKYVNFLYLAS
HYEKLKGSPEDNEQKQLFVEQHKHYLDEIIEQISEFSKRVILADANLDKVLSAYNKHRDKPIREQAENIIHLFTLTNLGAPAAF
KYFDTTIDRKRYTSTKEVLDATLIHQSITGLYETRIDLSQLGGD

FIG. 6

*Staphylococcus aureus* Cas9

MKRNYILGLDIGITSVGYGIIDYETRDVIDAGVRLFKEANVENNEGRRSKRGARRLKRRRRHRIQRVKKLLFDYNLLTDHSEL
SGINPYEARVKGLSQKLSEEEFSAALLHLAKRRGVHNVNEVEEDTGNELSTKEQISRNSKALEEKYVAELQLERLKKDGEV
RGSINRFKTSDYVKEAKQLLKVQKAYHQLDQSFIDTYIDLLETRRTYYEGPGEGSPFGWKDIKEWYEMLMGHCTYFPEELR
SVKYAYNADLYNALNDLNNLVITRDENEKLEYYEKFQIIENVFKQKKKPTLKQIAKEILVNEEDIKGYRVTSTGKPEFTNLKVY
HDIKDITARKEIIENAELLDQIAKILTIYQSSEDIQEELTNLNSELTQEEIEQISNLKGYTGTHNLSLKAINLILDELWHTNDNQIAI
FNRLKLVPKKVDLSQQKEIPTTLVDDFILSPVVKRSFIQSIKVINAIIKKYGLPNDIIIELAREKNSKDAQKMINEMQKRNRQTN
ERIEEIIRTTGKENAKYLIEKIKLHDMQEGKCLYSLEAIPLEDLLNNPFNYEVDHIIPRSVSFDNSFNNKVLVKQEENSKKGNR
TPFQYLSSSDSKISYETFKKHILNLAKGKGRISKTKKEYLLEERDINRFSVQKDFINRNLVDTRYATRGLMNLLRSYFRVNNL
DVKVKSINGGFTSFLRRKWKFKKERNKGYKHHAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTLIVNNLNGLYDKDNDKLKKLINKSPEKLLMYHHDP
QTYQKLKLIMEQYGDEKNPLYKYYEETGNYLTKYSKKDNGPVIKKIKYYGNKLNAHLDITDDYPNSRNKVVKLSLKPYRFDV
YLDNGVYKFVTVKNLDVIKKENYYEVNSKCYEEAKKLKKISNQAEFIASFYNNDLIKINGELYRVIGVNNDLLNRIEVNMIDITY
REYLENMNDKRPPRIIKTIASKTQSIKKYSTDILGNLYEVKSKKHPQIIKKG

FIG. 7A

*Francisella tularensis* Cpf1

```
   1 MSIYQEFVNK YSLSKTLRFE LIPQGKTLEN IKARGLILDD EKRAKDYKKA KQIIDKYHQF
  61 FIEEILSSVC ISEDLLQNYS DVYFKLKKSD DDNLQKDFKS AKDTIKKQIS EYIKDSEKFK
 121 NLFNQNLIDA KKGQESDLIL WLKQSKDNGI ELFKANSDIT DIDEALEIIK SFKGWTTYFK
 181 GFHENRKNVY SSNDIPTSII YRIVDDNLPK FLENKAKYES LKDKAPEAIN YEQIKKDLAE
 241 ELTFDIDYKT SEVNQRVFSL DEVFEIANFN NYLNQSGITK FNTIIGGKFV NGENTKRKGI
 301 NEYINLYSQQ INDKTLKKYK MSVLFKQILS DTESKSFVID KLEDDSDVVT TMQSFYEQIA
 361 AFKTVEEKSI KETLSLLFDD LKAQKLDLSK IYFKNDKSLT DLSQQVFDDY SVIGTAVLEY
 421 ITQQIAPKNL DNPSKKEQEL IAKKTEKAKY LSLETIKLAL EEFNKHRDID KQCRFEEILA
 481 NFAAIPMIFD EIAQNKDNLA QISIKYQNQG KKDLLQASAE DDVKAIKDLL DQTNNLLHKL
 541 KIFHISQSED KANILDKDEH FYLVFEECYF ELANIVPLYN KIRNYITQKP YSDEKFKLNF
 601 ENSTLANGWD KNKEPDNTAI LFIKDDKYYL GVMNKKNNKI FDDKAIKENK GEGYKKIVYK
 661 LLPGANKMLP KVFFSAKSIK FYNPSEDILR IRNHSTHTKN GSPQKGYEKF EFNIEDCRKF
 721 IDFYKQSISK HPEWKDFGFR FSDTQRYNSI DEFYREVENQ GYKLTFENIS ESYIDSVVNQ
 781 GKLYLFQIYN KDFSAYSKGR PNLHTLYWKA LFDERNLQDV VYKLNGEAEL FYRKQSIPKK
 841 ITHPAKEAIA NKNKDNPKKE SVFEYDLIKD KRFTEDKFFF HCPITINFKS SGANKFNDEI
 901 NLLLKEKAND VHILSIDRGE RHLAYYTLVD GKGNIIKQDT FNIIGNDRMK TNYHDKLAAI
 961 EKDRDSARKD WKKINNIKEM KEGYLSQVVH EIAKLVIEYN AIVVFEDLNF GFKRGRFKVE
1021 KQVYQKLEKM LIEKLNYLVF KDNEFDKTGG VLRAYQLTAP FETFKKMGKQ TGIIYYVPAG
1081 FTSKICPVTG FVNQLYPKYE SVSKSQEFFS KFDKICYNLD KGYFEFSFDY KNFGDKAAKG
1141 KWTIASFGSR LINFRNSDKN HNWDTREVYP TKELEKLLKD YSIEYGHGEC IKAAICGESD
1201 KKFFAKLTSV LNTILQMRNS KTGTELDYLI SPVADVNGNF FDSRQAPKNM PQDADANGAY
1261 HIGLKGLMLL GRIKNNQEGK KLNLVIKNEE YFEFVQNRNN

FIG. 7B

*Acidaminococcus sp. BV3L6* type V CRISPR-associated protein Cpf1

TQFEGFTNLYQVSKTLRFELIPQGKTLKHIQEQGFIEEDKARNDHYKELKPIIDRIYKTYADQCLQLVQLDWENLSAAIDSYR
KEKTEETRNALIEEQATYRNAIHDYFIGRTDNLTDAINKRHAEIYKGLFKAELFNGKVLKQLGTVTTTEHENALLRSFDKFTT
YFSGFYENRKNVFSAEDISTAIPHRIVQDNFPKFKENCHIFTRLITAVPSLREHFENVKKAIGIFVSTSIEEVFSFPFYNQLLTQTQ
IDLYNQLLGGISREAGTEKIKGLNEVLNLAIQKNDETAHIIASLPHRFIPLFKQILSDRNTLSFILEEFKSDEEVIQSFCKYKTLLR
NENVLETAEALFNELNSIDLTHIFISHKKKLETISSALCDHWDTLRNALYERRISELTGKITKSAKEKVQRSLKHEDINLQEIISAA
GKELSEAFKQKTSEILSHAHAALDQPLPTTLKKQEEKEILKSQLDSLLGLYHLLDWFAVDESNEVDPEFSARLTGIKLEMEPSL
SFYNKARNYATKKPYSVEKFKLNFQMPTLASGWDVNKEKNNGAILFVKNGLYYLGIMPKQKGRYKALSFEPTEKTSEGFD
KMYYDYFPDAAKMIPKCSTQLKAVTAHFQTHTTPILLSNNFIEPLEITKEIYDLNNPEKEPKKFQTAYAKKTGDQKGYREALC
KWIDFTRDFLSKYTKTTSIDLSSLRPSSQYKDLGEYYAELNPLLYHISFQRIAEKEIMDAVETGKLYLFQIYNKDFAKGHHGKP
NLHTLYWTGLFSPENLAKTSIKLNGQAELFYRPKSRMKRMAHRLGEKMLNKKLKDQKTPIPDTLYQELYDYVNHRLSHDLS
DEARALLPNVITKEVSHEIIKDRRFTSDKFFFHVPITLNYQAANSPSKFNQRVNAYLKEHPETPIIGIDRGERNLIYITVIDSTGKI
LEQRSLNTIQQFDYQKKLDNREKERVAARQAWSVVGTIKDLKQGYLSQVIHEIVDLMIHYQAVVVLENLNFGFKSKRTGIAE
KAVYQQFEKMLIDKLNCLVLKDYPAEKVGGVLNPYQLTDQFTSFAKMGTQSGFLFYVPAPYTSKIDPLTGFVDPFVWKTIK
NHESRKHFLEGFDFLHYDVKTGDFILHFKMNRRNLSFQRGLPGFMPAWDIVFEKNETQFDAKGTPFIAGKRIVPVIENHRFTGR
YRDLYPANELIALLEEKGIVFRDGSNILPKLLENDDSHAIDTMVALIRSVLQMRNSNAATGEDYINSPVRDLNGVCFDSRFQN
PEWPMDADANGAYHIALKGQLLLNHLKESKDLKLQNGISNQDWLAYIQELRN

FIG. 7C

>nCpf1 (AsCpf1 R1225A)

TQFEGFTNLYQVSKTLRFELIPQGKTLKHIQEQGFIEEDKARNDHYKELKPIIDRIYKTYADQCLQLVQLDWENLSAAIDSYR
KEKTEETRNALIEEQATYRNAIHDYFIGRTDNLTDAINKRHAEIYKGLFKAELFNGKVLKQLGTVTTTEHENALLRSFDKFTT
YFSGFYENRKNVFSAEDISTAIPHRIVQDNFPKFKENCHIFTRLITAVPSLREHFENVKKAIGIFVSTSIEEVFSFPFYNQLLTQTQ
IDLYNQLLGGISREAGTEKIKGLNEVLNLAIQKNDETAHIIASLPHRFIPLFKQILSDRNTLSFILEEFKSDEEVIQSFCKYKTLLR
NENVLETAEALFNELNSIDLTHIFISHKKKLETISSALCDHWDTLRNALYERRISELTGKITKSAKEKVQRSLKHEDINLQEIISAA
GKELSEAFKQKTSEILSHAHAALDQPLPTTLKKQEEKEILKSQLDSLLGLYHLLDWFAVDESNEVDPEFSARLTGIKLEMEPSL
SFYNKARNYATKKPYSVEKFKLNFQMPTLASGWDVNKEKNNGAILFVKNGLYYLGIMPKQKGRYKALSFEPTEKTSEGFD
KMYYDYFPDAAKMIPKCSTQLKAVTAHFQTHTTPILLSNNFIEPLEITKEIYDLNNPEKEPKKFQTAYAKKTGDQKGYREALC
KWIDFTRDFLSKYTKTTSIDLSSLRPSSQYKDLGEYYAELNPLLYHISFQRIAEKEIMDAVETGKLYLFQIYNKDFAKGHHGKP
NLHTLYWTGLFSPENLAKTSIKLNGQAELFYRPKSRMKRMAHRLGEKMLNKKLKDQKTPIPDTLYQELYDYVNHRLSHDLS
DEARALLPNVITKEVSHEIIKDRRFTSDKFFFHVPITLNYQAANSPSKFNQRVNAYLKEHPETPIIGIDRGERNLIYITVIDSTGKI
LEQRSLNTIQQFDYQKKLDNREKERVAARQAWSVVGTIKDLKQGYLSQVIHEIVDLMIHYQAVVVLENLNFGFKSKRTGIAE
KAVYQQFEKMLIDKLNCLVLKDYPAEKVGGVLNPYQLTDQFTSFAKMGTQSGFLFYVPAPYTSKIDPLTGFVDPFVWKTIK
NHESRKHFLEGFDFLHYDVKTGDFILHFKMNRRNLSFQRGLPGFMPAWDIVFEKNETQFDAKGTPFIAGKRIVPVIENHRFTGR
YRDLYPANELIALLEEKGIVFRDGSNILPKLLENDDSHAIDTMVALIRSVLQMANSNAATGEDYINSPVRDLNGVCFDSRFQN
PEWPMDADANGAYHIALKGQLLLNHLKESKDLKLQNGISNQDWLAYIQELRN

FIG. 8A

\>Pol1M (D424A)

MVQIPQNPLILVDGSSYLYRAYHAFPPLTNSAGEPTGAMYGVLNMLRSLIMQYKPTHAAVVFDAKGKTFRDELFEHYKSHR
PPMPDDLRAQIEPLHAMVKAMGLPLLAVSGVEADDVIGTLAREAEKAGRPVLISTGDKDMAQLVTPNITLINTMTNTILGPE
EVVNKYGVPPELIIDFLALMGDSSDNIPGVPGVGEKTAQALLQGLGGLDTLYAEPEKIAGLSFRGAKTMAAKLEQNKEVAYL
SYQLATIKTDVELELTCEQLEVQQPAAEELLGLFKKYEFKRWTADVEAGKWLQAKGAKPAAKPQETSVADEAPEVTATVIS
YDNYVTILDEETLKAWIAKLEKAPVFAFDTETDSLDNISANLVGLSFAIEPGVAAYIPVAHDYLDAPDQISRERALELLKPLLE
DEKALKVGQNLKYARGILANYGIELRGIAFDTMLESYILNSVAGRHDMDSLAERWLKHKTITFEEIAGKGKNQLTFNQIALE
EAGRYAAEDADVTLQLHLKMWPDLQKHKGPLNVFENIEMPLVPVLSRIERNGVKIDPKVLHNHSEELTLRLAELEKKAHEIA
GEEFNLSSTKQLQTILFEKQGIKPLKKTPGGAPSTSEEVLEELALDYPLPKVILEYRGLAKLKSTYTDKLPLMINPKTGRVHTS
YHQAVTATGRLSSTDPNLQNIPVRNEEGRRIRQAFIAPEDYVIVSADYSQIELRIMAHLSRDKGLLTAFAEGKDIHRATAAEVF
GLPLETVTSEQRRSAKAINFGLIYGMSAFGLARQLNIPRKEAQKYMDLYFERYPGVLEYMERTRAQAKEQGYVETLDGRRL
YLPDIKSSNGARRAAAERAAINAPMQGTAADIIKRAMIAVDAWLQAEQPRVRMIMQVHDELVFEVHKDDVDAVAKQIHQL
MENCTRLDVPLLVEVGSGENWDQAH

FIG. 8B

\>Pol2M (D424A, I709N)

MVQIPQNPLILVDGSSYLYRAYHAFPPLTNSAGEPTGAMYGVLNMLRSLIMQYKPTHAAVVFDAKGKTFRDELFEHYKSHR
PPMPDDLRAQIEPLHAMVKAMGLPLLAVSGVEADDVIGTLAREAEKAGRPVLISTGDKDMAQLVTPNITLINTMTNTILGPE
EVVNKYGVPPELIIDFLALMGDSSDNIPGVPGVGEKTAQALLQGLGGLDTLYAEPEKIAGLSFRGAKTMAAKLEQNKEVAYL
SYQLATIKTDVELELTCEQLEVQQPAAEELLGLFKKYEFKRWTADVEAGKWLQAKGAKPAAKPQETSVADEAPEVTATVIS
YDNYVTILDEETLKAWIAKLEKAPVFAFDTETDSLDNISANLVGLSFAIEPGVAAYIPVAHDYLDAPDQISRERALELLKPLLE
DEKALKVGQNLKYARGILANYGIELRGIAFDTMLESYILNSVAGRHDMDSLAERWLKHKTITFEEIAGKGKNQLTFNQIALE
EAGRYAAEDADVTLQLHLKMWPDLQKHKGPLNVFENIEMPLVPVLSRIERNGVKIDPKVLHNHSEELTLRLAELEKKAHEIA
GEEFNLSSTKQLQTILFEKQGIKPLKKTPGGAPSTSEEVLEELALDYPLPKVILEYRGLAKLKSTYTDKLPLMINPKTGRVHTS
YHQAVTATGRLSSTDPNLQNIPVRNEEGRRIRQAFIAPEDYVIVSADYSQNELRIMAHLSRDKGLLTAFAEGKDIHRATAAEV
FGLPLETVTSEQRRSAKAINFGLIYGMSAFGLARQLNIPRKEAQKYMDLYFERYPGVLEYMERTRAQAKEQGYVETLDGRR
LYLPDIKSSNGARRAAAERAAINAPMQGTAADIIKRAMIAVDAWLQAEQPRVRMIMQVHDELVFEVHKDDVDAVAKQIHQ
LMENCTRLDVPLLVEVGSGENWDQAH

FIG. 8C

PolI 3M DNA Polymerase (D424A; I709N; A759R)

```
  1 MVQIPQNPLI LVDGSSYLYR AYHAFPPLTN SAGEPTGAMY GVLNMLRSLI MQYKPTHAAV
 61 VFDAKGKTFR DELFEHYKSH RPPMPDDLRA QIEPLHAMVK AMGLPLLAVS GVEADDVIGT
121 LAREAEKAGR PVLISTGDKD MAQLVTPNIT LINTMTNTIL GPEEVVNKYG VPPELIIDFL
181 ALMGDSSDNI PGVPGVGEKT AQALLQGLGG LDTLYAEPEK IAGLSFRGAK TMAAKLEQNK
241 EVAYLSYQLA TIKTDVELEL TCEQLEVQQP AAEELLGLFK KYEFKRWTAD VEAGKWLQAK
301 GAKPAAKPQE TSVADEAPEV TATVISYDNY VTILDEETLK AWIAKLEKAP VFAFDTETDS
361 LDNISANLVG LSFAIEPGVA AYIPVAHDYL DAPDQISRER ALELLKPLLE DEKALKVGQN
421 LKYARGILAN YGIELRGIAF DTMLESYILN SVAGRHDMDS LAERWLKHKT ITFEEIAGKG
481 KNQLTFNQIA LEEAGRYAAE DADVTLQLHL KMWPDLQKHK GPLNVFENIE MPLVPVLSRI
541 ERNGVKIDPK VLHNHSEELT LRLAELEKKA HEIAGEEFNL SSTKQLQTIL FEKQGIKPLK
601 KTPGGAPSTS EEVLEELALD YPLPKVILEY RGLAKLKSTY TDKLPLMINP KTGRVHTSYH
661 QAVTATGRLS STDPNLQNIP VRNEEGRRIR QAFIAPEDYV IVSADYSQNE LRIMAHLSRD
721 KGLLTAFAEG KDIHRATAAE VFGLPLETVT SEQRRSAKRI NFGLIYGMSA FGLARQLNIP
781 RKEAQKYMDL YFERYPGVLE YMERTRAQAK EQGYVETLDG RRLYLPDIKS SNGARRAAAE
841 RAAINAPMQG TAADIIKRAM IAVDAWLQAE QPRVRMIMQV HDELVFEVHK DDVDAVAKQI
901 HQLMENCTRL DVPLLVEVGS GENWDQAH (SEQ ID NO://)
```

FIG. 8D

>PolI3M-TBD (increases mutagenesis window length)

VQIPQNPLILVDGSSYLYRAYHAFPPLTNSAGEPTGAMYGVLNMLRSLIMQYKPTHAAVVFDAKGKTFRDELFEHYKSHRPP
MPDDLRAQIEPLHAMVKAMGLPLLAVSGVEADDVIGTLAREAEKAGRPVLISTGDKDMAQLVTPNITLINTMTNTILGPEEV
VNKYGVPPELIIDFLALMGDSSDNIPGVPGVGEKTAQALLQGLGGLDTLYAEPEKIAGLSFRGAKTMAAKLEQNKEVAYLSY
QLATIKTDVELELTCEQLEVQQPAAEELLGLFKKYEFKRWTADVEAGKWLQAKGAKPAAKPQETSVADEAPEVTATVISYD
NYVTILDEETLKAWIAKLEKAPVFAFDTETDSLDNISANLVGLSFAIEPGVAAYIPVAHDYLDAPDQISRERALELLKPLLEDE
KALKVGQNLKYARGILANYGIELRGIAFDTMLESYILNSVAGRHDMDSLAERWLKHKTITFEEIAGKGKNQLTFNQIALEEA
GRYAAEDADVTLQLHLKMWPDLQKHKGPLNVFENIEMPLVPVLSRIERNGVKIDPKVLHNHSEELTLRLAELEKKATETFGS
WYQPKGGTEMFCHPRTGKPLPKYPRIKTPKVGGIFKKPKNKAQREGREPCELDTREYVAGAPYTPVEHVVFNLSSTKQLQTI
LFEKQGIKPLKKTPGGAPSTSEEVLEELALDYPLPKVILEYRGLAKLKSTYTDKLPLMINPKTGRVHTSYHQAVTATGRLSST
DPNLQNIPVRNEEGRRIRQAFIAPEDYVIVSADYSQNELRIMAHLSRDKGLLTAFAEGKDIHRATAAEVFGLPLETVTSEQRRS
AKRINFGLIYGMSAFGLARQLNIPRKEAQKYMDLYFERYPGVLEYMERTRAQAKEQGYVETLDGRRLYLPDIKSSNGARRA
AAERAAINAPMQGTAADIIKRAMIAVDAWLQAEQPRVRMIMQVHDELVFEVHKDDVDAVAKQIHQLMENCTRLDVPLLVE
VGSGENWDQAH

FIG. 9

Phi29 DNA polymerase

>sp|P03680|DPOL_BPPH2 DNA polymerase
OS=Bacillus phage phi29 GN=2 PE=1 SV=1

```
         10         20         30         40         50
 MKHMPRKMYS CDFETTTKVE DCRVWAYGYM NIEDHSEYKI GNSLDEFMAW
         60         70         80         90        100
 VLKVQADLYF HNLKFDGAFI INWLERNGFK WSADGLPNTY NTIISRMGQW
        110        120        130        140        150
 YMIDICLGYK GKRKIHTVIY DSLKKLPFPV KKIAKDFKLT VLKGDIDYHK
        160        170        180        190        200
 ERPVGYKITP EEYAYIKNDI QIIAEALLIQ FKQGLDRMTA GSDSLKGFKD
        210        220        230        240        250
 IITTKKFKKV FPTLSLGLDK EVRYAYRGGF TWLNDRFKEK EIGEGMVFDV
        260        270        280        290        300
 NSLYPAQMYS RLLPYGEPIV FEGKYVWDED YPLHIQHIRC EFELKEGYIP
        310        320        330        340        350
 TIQIKRSRFY KGNEYLKSSG GEIADLWLSN VDLELMKEHY DLYNVEYISG
        360        370        380        390        400
 LKFKATTGLF KDFIDKWTYI KTTSEGAIKQ LAKLMLNSLY GKFASNPDVT
        410        420        430        440        450
 GKVPYLKENG ALGFRLGEEE TKDPVYTPMG VFITAWARYT TITAAQACYD
        460        470        480        490        500
 RIIYCDTDSI HLTGTEIPDV IKDIVDPKKL GYWAHESTFK RAKYLRQKTY
        510        520        530        540        550
 IQDIYMKEVD GKLVEGSPDD YTDIKFSVKC AGMTDKIKKE VTFENFKVGF
        560        570
 SRKMKPKPVQ VPGGVVLVDD TFTIK
```

FIG. 10

T5 DNA polymerase
GenBank Accession AAA32561

```
  1 mysicvtrsc pvvcskkhit igtpenpfdp ndydfvilvg aepflyfagk kgigdytgkr
 61 veyngyanwi asispaqlhf kpemkpvfda tvenihdiin grekiakagd yrpitdpdea
121 eeyikmvynm vigpvafdse tsalycrdgy llgvsishqe yqgvyidsdc ltevavyylq
181 kildsenhti vfhnlkfdmh fkyhlgltf dkahkerrlh dtmlqhyvld errgthglks
241 lamkytdmgd ydfeldkfkd dyckahkikk edftydlipf dimwpyaakd tdatirlhnf
301 flpkieknek lcslyydvlm pgcvflqrve drgvpisidr lkeaqyqlth nlnkarekly
361 typevkqleq dqneafnpns vkqlrvllfd yvgltptgkl tdtgadstda ealnelatqh
421 piaktlleir kltklistyv ekillsidad gcirtgfheh mttsgrlsss gklnlqqlpr
481 desiikgcvv appgyrviaw dlttaevyya avlsgdrnmq qvfinmrnep dkypdfhsni
541 ahmvfklqce prdvkklfpa lrqaakaitf gilygsgpak vahsvneall eqaaktgepf
601 vectvadake yietyfgqfp qlkrwidkch dqiknhgfiy shfgrkrrlh nihsedrgvq
661 geeirsgfna iiqsassdsl llgavdadne iislgleqem kivmlvhdsv vaivredlid
721 qyneilirni qkdrgisipg cpigidsdse aggsrdyscg kmkkqhpsia cidddeytry
781 vkgvlldaef eykklaamdk ehpdhskykd dkfiavckdl dnvkrilga
```

FIG. 11A

T7 DNA polymerase
GenBank Accession No. WP_005490218

```
  1 mnerlcydie tdglieevtk lhciaiinvd tleealyads lvmmtqgtik dgldrlnkas
 61 ltlghniiky dhpvinkltg yelpkdksfd tlvasrlvfs nikdidqgns gkytlgklfg
121 shsleawgir lggqqkmeya pvidpaqpvy dptvkpkdak kdprwkgsif tpmmgdycmq
181 dvrvnvelfr rlerkihqlg yarsmllehe aawvlaqqer ngfkfdeeka ikllgrlagr
241 reylynklie tfggwwvsdg vsvpartiny kdptkpsrvq gapftvkwv dfnpssrrhi
301 ikvltdrgwt pqeftpsgea kvdesilkel dfpearlmae wflvqkrlgq ladgnqawln
361 tvhpdgfirg svnpngavtg rathsfpnva qvpscsaeyg aecrelftvp dgwyllgsda
421 sglelrclan fmaryddgky idvvlngdih wsnaqaagfi pkgtirdphn piheearrka
481 ktfiyaflyg cgaeltgqqv gwteeeylnw kakgahkpii nrfkrqgkpw trekicnilk
541 geevqknfmk glpalknlid eckelhkeqg yiegidgrri ytrsahasln tllqgagalv
601 ckawiveiek laiaeglkhg idgdfmycaw vhdevqiacr tkeiaerigq lcqvamtnve
661 kefnfvcrld adfdigkswk eth
```

FIG. 11B

>Sequenase (T7 dna polymerase with a 28 amino acid deletion) with L452N and T523R mutations, and the 5' exonuclease domain from E. coli DNA polymerase I

```
VQIPQNPLILVDGSSYLYRAYHAFPPLTNSAGEPTGAMYGVLNMLRSLIMQYKPTHAAVVFDAKGKTFRDELFEHYKSHRPP
MPDDLRAQIEPLHAMVKAMGLPLLAVSGVEADDVIGTLAREAEKAGRPVLISTGDKDMAQLVTPNITLINTMTNTILGPEEV
VNKYGVPPELIIDFLALMGDSSDNIPGVPGVGEKTAQALLQGLGGLDTLYAEPEKIAGLSFRGAKTMAAKLEQNKEVAYLSY
QLATIKTDVELELTCEQLEVQQPAAEELLGLFKKYEFKRWTADVEAGKWLQAKGAKPAAKPQETSVADEAPEVTATVIGSI
VSDIEANALLESVTKFHCGVIYDYSTAEYVSYRPSDFGAYLDALEAEVARGGLIVFHNGHKYDVPALTKLAKLQLNREFHLP
RENCIDTLVLSRLIHSNLKDTDMGLLRSGKLPGMLEEQGEEYVDGMEWWNFNEEMMDYNVQDVVVTKALLEKLLSDKHY
FPPEIDFTDVGYTTFWSESLEAVDIEHRAAWLLAKQERNGFPFDTKAIEELYVELAARRSELLRKLTETFGSWYQPKGGTEMF
CHPRTGKPLPKYPRIKTPKVGGIFKKPKNKAQREGREPCELDTREYVAGAPYTPVEHVVFNPSSRDHIQKKLQEAGWVPTKY
TDKGAPVVDDEVLEGVRVDDPEKQAAIDLIKEYLMIQKRIGQSAEGDKAWLRYVAEDGKIHGSVNPNGAVTGRATHAFPNL
AQIPGVRSPYGEQCRAAFGAEHHLDGITGKPWVQAGIDASGNELRCLAHFMARFDNGEYAHEILNGDIHTKNQIAAELPTRD
NAKRFIYGFLYGAGDEKIGQIVGAGKERGKELKKKFLENTPAIAALRESIQQTLVESSQWVAGEQQVKWKRRWIKGLDGRK
VHVRSPHAALNTLLQSAGALICKLWIIKTEEMLVEKGLKHGWDGDFAYMAWVHDEIQVGCRTEEIAQVVIETAQEAMRWV
GDHWNFRCLLDTEGKMGPNWAICH
```

FIG. 12

Sso7d

>sp|P39476|DN7D_SULSO DNA-binding protein 7d OS=Sulfolobus
solfataricus (strain ATCC 35092 / DSM 1617 / JCM
11322 / P2) GN=sso7d PE=1 SV=2

MATVKFKYKGEEKEVDISKIKKVWRVGKMISFTYDEGGGKTGRGAVSEKDAPKELLQMLEKQKK

FIG. 13

DNA Polymerase Iota

```
MEKLGVEPEE EGGGDDDEED AEAWAMELAD VGAAASSQGV HDQVLPTPNA
    60         70         80         90        100
SSRVIVHVDL DCFYAQVEMI SNPELKDKPL GVQQKYLVVT CNYEARKLGV
   110        120        130        140        150
KKLMNVRDAK EKCPQLVLVN GEDLTRYREM SYKVTELLEE FSPVVERLGF
   160        170        180        190        200
DENFVDLTEM VEKRLQQLQS DELSAVTVSG HVYNNQSINL LDVLHIRLLV
   210        220        230        240        250
GSQIAAEMRE AMYNQLGLTG CAGVASNKLL AKLVSGVFKP NQQTVLLPES
   260        270        280        290        300
CQHLIHSLNH IKEIPGIGYK TAKCLEALGI NSVRDLQTFS PKILEKELGI
   310        320        330        340        350
SVAQRIQKLS FGEDNSPVIL SGPPQSFSEE DSFKKCSSEV EAKNKIEELL
   360        370        380        390        400
ASLLNRVCQD GRKPHTVRLI IRRYSSEKHY GRESRQCPIP SHVIQKLGTG
   410        420        430        440        450
NYDVMTPMVD ILMKLFRNMV NVKMPFHLTL LSVCFCNLKA LNTAKKGLID
   460        470        480        490        500
YYLMPSLSTT SRSGKHSFKM KDTHMEDFPK DKETNRDFLP SGRIESTRTR
   510        520        530        540        550
ESPLDTTNFS KEKDINEFPL CSLPEGVDQE VFKQLPVDIQ EEILSGKSRE
   560        570        580        590        600
KFQGKGSVSC PLHASRGVLS FFSKKQMQDI PINPRDHLSS SKQVSSVSPC
   610        620        630        640        650
EPGTSGFNSS SSSYMSSQKD YSYYLDNRLK DERISQGPKE PQGFHFTNSN
   660        670        680        690        700
PAVSAFHSFP NLQSEQLFSR NHTTDSHKQT VATDSHEGLT ENREPDSVDE
   710        720        730        740
KITFPSDIDP QVFYELPEAV QKELLAEWKR AGSDFHIGHK
```

FIG. 14A

DNA Polymerase η

```
         10         20         30         40         50
 MATGQDRVVA LVDMDCFFVQ VEQRQNPHLR NKPCAVVQYK SWKGGGIIAV
         60         70         80         90        100
 SYEARAFGVT RSMWADDAKK LCPDLLLAQV RESRGKANLT KYREASVEVM
        110        120        130        140        150
 EIMSRFAVIE RASIDEAYVD LTSAVQERLQ KLQGQPISAD LLPSTYIEGL
        160        170        180        190        200
 PQGPTTAEET VQKEGMRKQG LFQWLDSLQI DNLTSPDLQL TVGAVIVEEM
        210        220        230        240        250
 RAAIERETGF QCSAGISHNK VLAKLACGLN KPNRQTLVSH GSVPQLFSQM
        260        270        280        290        300
 PIRKIRSLGG KLGASVIEIL GIEYMGELTQ FTESQLQSHF GEKNGSWLYA
        310        320        330        340        350
 MCRGIEHDPV KPRQLPKTIG CSKNFPGKTA LATREQVQWW LLQLAQELEE
        360        370        380        390        400
 RLTKDRNDND RVATQLVVSI RVQGDKRLSS LRRCCALTRY DAHKMSHDAF
        410        420        430        440        450
 TVIKNCNTSG IQTEWSPPLT MLFLCATKFS ASAPSSSTDI TSFLSSDPSS
        460        470        480        490        500
 LPKVPVTSSE AKTQGSGPAV TATKKATTSL ESFFQKAAER QKVKEASLSS
        510        520        530        540        550
 LTAPTQAPMS NSPSKPSLPF QTSQSTGTEP FFKQKSLLLK QKQLNNSSVS
        560        570        580        590        600
 SPQQNPWSNC KALPNSLPTE YPGCVPVCEG VSKLEESSKA TPAEMDLAHN
        610        620        630        640        650
 SQSMHASSAS KSVLEVTQKA TPNPSLLAAE DQVPCEKCGS LVPVWDMPEH
        660        670        680        690        700
 MDYHFALELQ KSFLQPHSSN PQVVSAVSHQ GKRNPKSPLA CTNKRPRPEG
```

FIG. 14B

```
        710
 MQTLESFFKP LTH
```

FIG. 15A

DNA Polymerase κ

```
         10         20         30         40         50
MDSTKEKCDS YKDDLLLRMG LNDNKAGMEG LDKEKINKII MEATKGSRFY
         60         70         80         90        100
GNELKKEKQV NQRIENMMQQ KAQITSQQLR KAQLQVDRFA MELEQSRNLS
        110        120        130        140        150
NTIVHIDMDA FYAAVEMRDN PELKDKPIAV GSMSMLSTSN YHARRFGVRA
        160        170        180        190        200
AMPGFIAKRL CPQLIIVPPN FDKYRAVSKE VKEILADYDP NFMAMSLDEA
        210        220        230        240        250
YLNITKHLEE RQNWPEDKRR YFIKMGSSVE NDNPGKEVNK LSEHERSISP
        260        270        280        290        300
LLFEESPSDV QPPGDPFQVN FEEQNNPQIL QNSVVFGTSA QEVVKEIRFR
        310        320        330        340        350
IEQKTTLTAS AGIAPNTMLA KVCSDKNKPN GQYQILPNRQ AVMDFIKDLP
        360        370        380        390        400
IRKVSGIGKV TEKMLKALGI ITCTELYQQR ALLSLLFSET SWHYFLHISL
        410        420        430        440        450
GLGSTHLTRD GERKSMSVER TFSEINKAEE QYSLCQELCS ELAQDLQKER
        460        470        480        490        500
LKGRTVTIKL KNVNFEVKTR ASTVSSVVST AEEIFAIAKE LLKTEIDADF
        510        520        530        540        550
PHPLRLRLMG VRISSFPNEE DRKHQQRSII GFLQAGNQAL SATECTLEKT
        560        570        580        590        600
DKDKFVKPLE MSHKKSFFDK KRSERKWSHQ DTFKCEAVNK QSFQTSQPFQ
        610        620        630        640        650
VLKKKMNENL EISENSDDCQ ILTCPVCFRA QGCISLEALN KHVDECLDGP
        660        670        680        690        700
SISENFKMFS CSHVSATKVN KKENVPASSL CEKQDYEAHP KIKEISSVDC
```

FIG. 15B

```
        710        720        730        740        750
IALVDTIDNS SKAESIDALS NKHSKEECSS LPSKSFNIEH CHQNSSSTVS
        760        770        780        790        800
LENEDVGSFR QEYRQPYLCE VKTGQALVCP VCNVEQKTSD LTLFNVHVDV
        810        820        830        840        850
CLNKSFIQEL RKDKFNPVNQ PKESSRSTGS SSGVQKAVTR TKRPGLMTKY
        860        870
STSKKIKPNN PKHTLDIFFK
```

FIG. 16A

DNA Polymerase θ

```
MNLLRRSGKR RRSESGSDSF SGSGGDSSAS PQFLSGSVLS PPPGLGRCLK
     60         70         80         90        100
AAAAGECKPT VPDYERDKLL LANWGLPKAV LEKYHSFGVK KMFEWQAECL
    110        120        130        140        150
LLGQVLEGKN LVYSAPTSAG KTLVAELLIL KRVLEMRKKA LFILPFVSVA
    160        170        180        190        200
KEKKYYLQSL FQEVGIKVDG YMGSTSPSRH FSSLDIAVCT IERANGLINR
    210        220        230        240        250
LIEENKMDLL GMVVDELHM LGDSHRGYLL ELLLTKICYI TRKSASCQAD
    260        270        280        290        300
LASSLSNAVQ IVGMSATLPN LELVASWLNA ELYHTDFRPV PLLESVKVGN
    310        320        330        340        350
SIYDSSMKLV REFEPMLQVK GDEDHVVSLC YETICDNHSV LLFCPSKKWC
    360        370        380        390        400
EKLADIIARE FYNLHHQAEG LVKPSECPPV ILEQKELLEV MDQLRRLPSG
    410        420        430        440        450
LDSVLQKTVP WGVAFHHAGL TFEERDIIEG AFRQGLIRVL AATSTLSSGV
    460        470        480        490        500
NLPARRVIIR TPIFGGRPLD ILTYKQMVGR AGRKGVDTVG ESILICKNSE
    510        520        530        540        550
KSKGIALLQG SLKPVRSCLQ RREGEEVTGS MIRAILEIIV GGVASTSQDM
    560        570        580        590        600
HTYAACTFLA ASMKEGKQGI QRNQESVQLG AIEACVMWLL ENEFIQSTEA
    610        620        630        640        650
SDGTEGKVYH PTHLGSATLS SSLSPADTLD IFADLQRAMK GFVLENDLHI
    660        670        680        690        700
LYLVTPMFED WTTIDWYRFF CLWEKLPTSM KRVAELVGVE EGFLARCVKG
    710        720        730        740        750
KVVARTERQH RQMAIHKRFF TSLVLLDLIS EVPLREINQK YGCNRGQIQS
```

FIG. 16B

```
        760        770        780        790        800
 LQQSAAVYAG MITVFSNRLG WHNMELLLSQ FQKRLTFGIQ RELCDLVRVS
        810        820        830        840        850
 LLNAQRARVL YASGFHTVAD LARANIVEVE VILKNAVPFK SARKAVDEEE
        860        870        880        890        900
 EAVEERRNMR TIWVTGRKGL TEREAAALIV EEARMILQQD LVEMGVQWNP
        910        920        930        940        950
 CALLHSSTCS LTHSESEVKE HTFISQTKSS YKKLTSKNKS NTIFSDSYIK
        960        970        980        990       1000
 HSPNIVQDLN KSREHTSSFN CNFQNGNQEH QTCSIFRARK RASLDINKEK
       1010       1020       1030       1040       1050
 PGASQNEGKT SDKKVVQTFS QKTKKAPLNF NSEKMSRSFR SWKRRKHLKR
       1060       1070       1080       1090       1100
 SRDSSPLKDS GACRIHLQGQ TLSNPSLCED PFTLDEKKTE FRNSGPFAKN
       1110       1120       1130       1140       1150
 VSLSGKEKDN KTSFPLQIKQ NCSWNITLTN DNFVEHIVTG SQSKNVTCQA
       1160       1170       1180       1190       1200
 TSVVSEKGRG VAVEAEKINE VLIQNGSKNQ NVYMKHHDIH PINQYLRKQS
       1210       1220       1230       1240       1250
 HEQTSTITKQ KNIIERQMPC EAVSSYINRD SNVTINCERI KLNTEENKPS
       1260       1270       1280       1290       1300
 HFQALGDDIS RTVIPSEVLP SAGAFSKSEG QHENFLNISR LQEKTGTYTT
       1310       1320       1330       1340       1350
 NKTKNNHVSD LGLVLCDFED SFYLDTQSEK IIQQMATENA KLGAKDTNLA
       1360       1370       1380       1390       1400
 AGIMQKSLVQ QNSMNSFQKE CHIPFPAEQH PLGATKIDHL DLKTVGTMKQ
       1410       1420       1430       1440       1450
 SSDSHGVDIL TPESPIFHSP ILLEENGLFL KKNEVSVTDS QLNSFLQGYQ
       1460       1470       1480       1490       1500
 TQETVKPVIL LIPQKRTPTG VEGECLPVPE TSLNMSDSLL FDSFSDDYLV
```

FIG. 16C

```
      1510       1520       1530       1540       1550
 KEQLPDMQMK EPLPSEVTSN HFSDSLCLQE DLIKKSNVNE NQDTHQQLTC
      1560       1570       1580       1590       1600
 SNDESIIFSE MDSVQMVEAL DNVDIFPVQE KNHTVVSPRA LELSDPVLDE
      1610       1620       1630       1640       1650
 HHQGDQDGGD QDERAEKSKL TGTRQNHSFI WSGASFDLSP GLQRILDKVS
      1660       1670       1680       1690       1700
 SPLENEKLKS MTINFSSLNR KNTELNEEQE VISNLETKQV QGISFSSNNE
      1710       1720       1730       1740       1750
 VKSKIEMLEN NANHDETSSL LPRKESNIVD DNGLIPPTPI PTSASKLTFP
      1760       1770       1780       1790       1800
 GILETPVNPW KTNNVLQPGE SYLFGSPSDI KNHDLSPGSR NGFKDNSPIS
      1810       1820       1830       1840       1850
 DTSFSLQLSQ DGLQLTPASS SSESLSIIDV ASDQNLFQTF IKEWRCKKRF
      1860       1870       1880       1890       1900
 SISLACEKIR SLTSSKTATI GSRFKQASSP QEIPIRDDGF PIKGCDDTLV
      1910       1920       1930       1940       1950
 VGLAVCWGGR DAYYFSLQKE QKHSEISASL VPPSLDPSLT LKDRMWYLQS
      1960       1970       1980       1990       2000
 CLRKESDKEC SVVIYDFIQS YKILLLSCGI SLEQSYEDPK VACWLLDPDS
      2010       2020       2030       2040       2050
 QEPTLHSIVT SFLPHELPLL EGMETSQGIQ SLGLNAGSEH SGRYRASVES
      2060       2070       2080       2090       2100
 ILIFNSMNQL NSLLQKENLQ DVFRKVEMPS QYCLALLELN GIGFSTAECE
      2110       2120       2130       2140       2150
 SQKHIMQAKL DAIETQAYQL AGHSFSFTSS DDIAEVLFLE LKLPPNREMK
      2160       2170       2180       2190       2200
 NQGSKKTLGS TRRGIDNGRK LRLGRQFSTS KDVLNKLKAL HPLPGLILEW
      2210       2220       2230       2240       2250
 RRITNAITKV VFPLQREKCL NPFLGMERIY PVSQSHTATG RITFTEPNIQ
```

FIG. 16D

```
       2260       2270       2280       2290       2300
  NVPRDFEIKM PTLVGESPPS QAVGKGLLPM GRGKYKKGFS VNPRCQAQME
       2310       2320       2330       2340       2350
  ERAADRGMPF SISMRHAFVP FPGGSILAAD YSQLELRILA HLSHDRRLIQ
       2360       2370       2380       2390       2400
  VLNTGADVFR SIAAEWKMIE PESVGDDLRQ QAKQICYGII YGMGAKSLGE
       2410       2420       2430       2440       2450
  QMGIKENDAA CYIDSFKSRY TGINQFMTET VKNCKRDGFV QTILGRRRYL
       2460       2470       2480       2490       2500
  PGIKDNNPYR KAHAERQAIN TIVQGSAADI VKIATVNIQK QLETFHSTFK
       2510       2520       2530       2540       2550
  SHGHREGMLQ SDQTGLSRKR KLQGMFCPIR GGFFILQLHD ELLYEVAEED
       2560       2570       2580       2590
  VVQVAQIVKN EMESAVKLSV KLKVKVKIGA SWGELKDFDV
```

FIG. 17A

DNA Polymerase v (nu)

```
        10         20         30         40         50
MENYEALVGF DLCNTPLSSV AQKIMSAMHS GDLVDSKTWG KSTETMEVIN
        60         70         80         90        100
KSSVKYSVQL EDRKTQSPEK KDLKSLRSQT SRGSAKLSPQ SFSVRLTDQL
       110        120        130        140        150
SADQKQKSIS SLTLSSCLIP QYNQEASVLQ KKGHKRKHFL MENINNENKG
       160        170        180        190        200
SINLKRKHIT YNNLSEKTSK QMALEEDTDD AEGYLNSGNS GALKKHFCDI
       210        220        230        240        250
RHLDDWAKSQ LIEMLKQAAA LVITVMYTDG STQLGADQTP VSSVRGIVVL
       260        270        280        290        300
VKRQAEGGHG CPDAPACGPV LEGFVSDDPC IYIQIEHSAI WDQEQEAHQQ
       310        320        330        340        350
FARNVLFQTM KCKCPVICFN AKDFVRIVLQ FFGNDGSWKH VADFIGLDPR
       360        370        380        390        400
IAAWLIDPSD ATPSFEDLVE KYCEKSITVK VNSTYGNSSR NIVNQNVREN
       410        420        430        440        450
LKTLYRLTMD LCSKLKDYGL WQLFRTLELP LIPILAVMES HAIQVNKEEM
       460        470        480        490        500
EKTSALLGAR LKELEQEAHF VAGERFLITS NNQLREILFG KLKLHLLSQR
       510        520        530        540        550
NSLPRTGLQK YPSTSEAVLN ALRDLHPLPK IILEYRQVHK IKSTFVDGLL
       560        570        580        590        600
ACMKKGSISS TWNQTGTVTG RLSAKHPNIQ GISKHPIQIT TPKNFKGKED
       610        620        630        640        650
KILTISPRAM FVSSKGHTFL AADFSQIELR ILTHLSGDPE LLKLFQESER
       660        670        680        690        700
DDVFSTLTSQ WKDVPVEQVT HADREQTKKV VYAVVYGAGK ERLAACLGVP
```

FIG. 17B

```
       710        720        730        740        750
IQEAAQFLES FLQKYKKIKD FARAAIAQCH QTGCVVSIMG RRRPLPRIHA
       760        770        780        790        800
HDQQLRAQAE RQAVNFVQG SAADLCKLAM IHVFTAVAAS HTLTARLVAQ
       810        820        830        840        850
IHDELLFEVE DPQIPECAAL VRRTMESLEQ VQALELQLQV PLKVSLSAGR
       860        870        880        890        900
SWGHLVPLQE AWGPPPGPCR TESPSNSLAA PGSPASTQPP PLHFSPSFCL
```

FIG. 18

*E. coli* DNA Polymerase IV

```
         10         20         30         40         50
MRKIIHVDMD CFFAAVEMRD NPALRDIPIA IGGSRERRGV ISTANYPARK
         60         70         80         90        100
FGVRSAMPTG MALKLCPHLT LLPGRFDAYK EASNHIREIF SRYTSRIEPL
        110        120        130        140        150
SLDEAYLDVT DSVHCHGSAT LIAQEIRQTI FNELQLTASA GVAPVKFLAK
        160        170        180        190        200
IASDMNKPNG QFVITPAEVP AFLQTLPLAK IPGVGKVSAA KLEAMGLRTC
        210        220        230        240        250
GDVQKCDLVM LLKRFGKFGR ILWERSQGID ERDVNSERLR KSVGVERTMA
        260        270        280        290        300
EDIHHWSECE AIIERLYPEL ERRLAKVKPD LLIARQGVKL KFDDFQQTTQ
        310        320        330        340        350
EHVWPRLNKA DLIATARKTW DERRGGRGVR LVGLHVTLLD PQMERQLVLG

Topoisomerase I

```
         10         20         30         40         50
MSGDHLHNDS QIEADFRLND SHKHKDKHKD REHRHKEHKK EKDREKSKHS
         60         70         80         90        100
NSEHKDSEKK HKEKEKTKHK DGSSEKHKDK HKDRDKEKRK EEKVRASGDA
        110        120        130        140        150
KIKKEKENGF SSPPQIKDEP EDDGYFVPPK EDIKPLKRPR DEDDADYKPK
        160        170        180        190        200
KIKTEDTKKE KKRKLEEEED GKLKKPKNKD KDKKVPEPDN KKKKPKKEEE
        210        220        230        240        250
QKWKWWEEER YPEGIKWKFL EHKGPVFAPP YEPLPENVKF YYDGKVMKLS
        260        270        280        290        300
PKAEEVATFF AKMLDHEYTT KEIFRKNFFK DWRKEMTNEE KNIITNLSKC
        310        320        330        340        350
DFTQMSQYFK AQTEARKQMS KEEKLKIKEE NEKLLKEYGF CIMDNHKERI
        360        370        380        390        400
ANFKIEPPGL FRGRGNHPKM GMLKRRIMPE DIIINCSKDA KVPSPPPGHK
        410        420        430        440        450
WKEVRHDNKV TWLVSWTENI QGSIKYIMLN PSSRIKGEKD WQKYETARRL
        460        470        480        490        500
KKCVDKIRNQ YREDWKSEM KVRQRAVALY FIDKLALRAG NEKEEGETAD
        510        520        530        540        550
TVGCCSLRVE HINLHPELDG QEYVVEFDFL GKDSIRYYNK VPVEKRVFKN
        560        570        580        590        600
LQLFMENKQP EDDLFDRLNT GILNKHLQDL MEGLTAKVFR TYNASITLQQ
        610        620        630        640        650
QLKELTAPDE NIPAKILSYN RANRAVAILC NHQRAPPKTF EKSMMNLQTK
```

FIG. 19B

```
        660        670        680        690        700
IDAKKEQLAD ARRDLKSAKA DAKVMKDAKT KKVVESKKKA VQRLEEQLMK
        710        720        730        740        750
LEVQATDREE NKQIALGTSK LNYLDPRITV AWCKKWGVPI EKIYNKTQRE
        760
KFAWAIDMAD EDYEF
```

FIG. 20

FEN1

```
  1 MGIQGLAKLI ADVAPSAIRE NDIKSYFGRK VAIDASMSIY QFLIAVRQGG DVLQNEEGET
 61 TSHLMGMFYR TIRMMENGIK PVYVFDGKPP QLKSGELAKR SERRAEAEKQ LQQAQAAGAE
121 QEVEKFTKRL VKVTKQHNDE CKHLLSLMGI PYLDAPSEAE ASCAALVKAG KVYAAATEDM
181 DCLTFGSPVL MRHLTASEAK KLPIQEFHLS RILQELGLNQ EQFVDLCILL GSDYCESIRG
241 IGPKRAVDLI QKHKSIEEIV RRLDPNKYPV PENWLHKEAH QLFLEPEVLD PESVELKWSE
301 PNEEELIKFM CGEKQFSEER IRSGVKRLSK SRQGSTQGRL DDFFKVTGSL SSAKRKEPEP
361 KGSTKKKAKT GAAGKFKRGK
```

FIG. 21

T4 DNA ligase

```
  1 MILKILNEIA SIGSTKQKQA ILEKNKDNEL LKRVYRLTYS RGLQYYIKKW PKPGIATQSF
 61 GMLTLTDMLD FIEFTLATRK LTGNAAIEEL TGYITDGKKD DVEVLRRVMM RDLECGASVS
121 IANKVWPGLI PEQPQMLASS YDEKGINKNI KFPAFAQLKA DGARCFAEVR GDELDDVRLL
181 SRAGNEYLGL DLLKEELIKM TAEARQIHPE GVLIDGELVY HEQVKKEPEG LDFLFDAYPE
241 NSKAKEFAEV AESRTASNGI ANKSLKGTIS EKEAQCMKFQ VWDYVPLVEI YSLPAFRLKY
301 DVRFSKLEQM TSGYDKVILI ENQVVNNLDE AKVIYKKYID QGLEGIILKN IDGLWENARS
361 KNLYKFKEVI DVDLKIVGIY PHRKDPTKAG GFILESECGK IKVNAGSGLK DKAGVKSHEL
421 DRTRIMENQN YYIGKILECE CNGWLKSDGR TDYVKLFLPI AIRLREDKTK ANTFEDVFGD
481 FHEVTGL
```

FIG. 23E
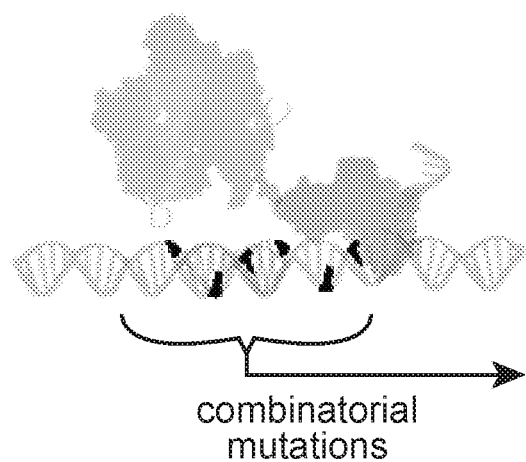
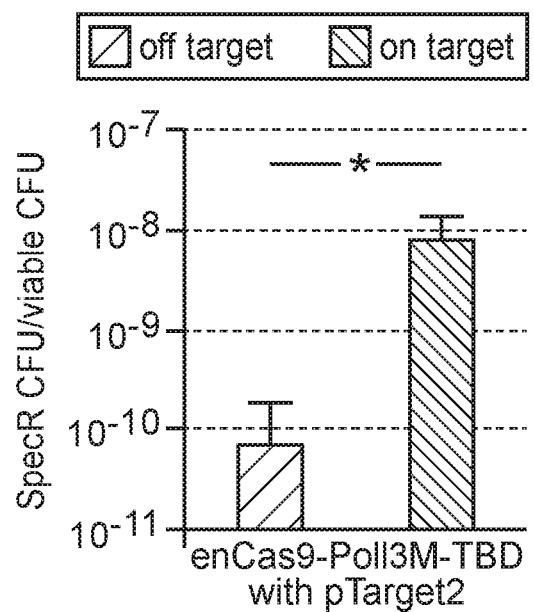
FIG. 23F
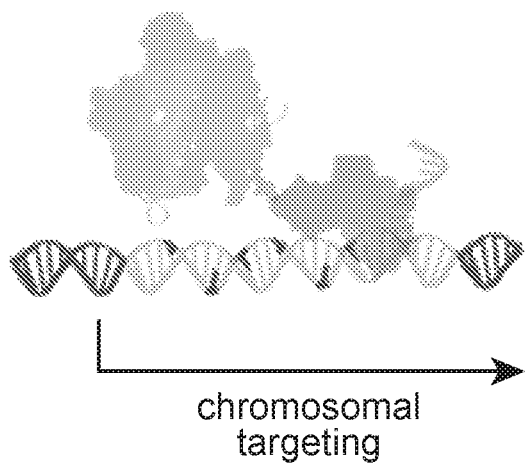
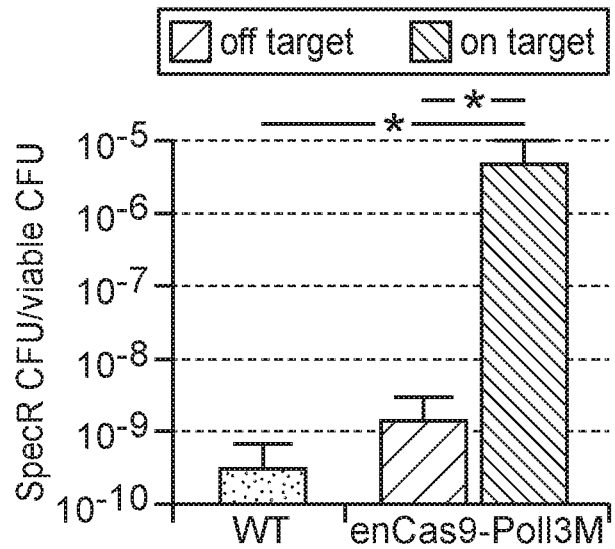

FIG. 33

| E. coli Diversification Method | Host/culture requirements | Targetability | Ease of use | In vivo/ Continuous? | When to use |
|---|---|---|---|---|---|
| XL1-Red[51] | Specific Strain | None | Transformation | Yes | Continuous whole genome evolution; target is unknown |
| MP6[52] | None | None | Transformation | Yes | Continuous whole genome evolution of any strain; target is unknown |
| Orthogonal polymerase/plasmid[1] | Specific strain and culture requirements | Plasmid | Transformation | Yes | Continuous plasmid evolution; target must be located next to the origin of replication of a specific plasmid |
| PACE[3] | Specific strain and culture requirements | Phage genome | Custom turbidostat operation, bacteriophage propogation | Yes | Continuous engineered phage genome evolution; target must be inserted within phage genome, and target activity must be coupled to phage propagation |
| MAGE[11] | Specific strain | User-defined targets | Recombination machinery induction and high-efficiency transformation of oligonucleotide library | No | Generating rationally designed, discrete, user-defined libraries of recombineering strains |
| EvolvR | None | User-defined targets | Transformation | Yes | Continuous diversification of user-defined genomic loci in any strain |

FIG. 34

| Oligonucleotides used in this study | |
|---|---|
| pTarget-F | GCTCTTCCGATCTNNNNNTCGACCCAGCTGTCGGAG (SEQ ID NO: 1116) |
| pTarget-R | GCTCTTCCGATCTNNNNNTCACTGTGTGGCTTCAGG (SEQ ID NO: 1117) |
| rpsE-F | GCTCTTCCGATCTNNNNNGCTGGCCTTCAGTTCTAAGGTAG (SEQ ID NO: 1118) |
| rpsE-R | GCTCTTCCGATCTNNNNNCGTTAATCATATTGCGACGGGC (SEQ ID NO: 1119) |
| rpsE-Δ26 | GTAACCAAAACCAACGCGACCGTTACCATCGCCAACTACAGTCAGAGCTGTGAAGGAGA AAATACGACCACCTaCGGTTTTAGATACGCG (SEQ ID NO: 1120) |
| rpsE-G27D | ACCGTAACCAAAACCAACGCGACCGTTACCATCGCCAACTACAGTCAGAGCTGTGAAGG AGAAAATACGACCAtCTTTAACGGTTTTAGA (SEQ ID NO: 1121) |
| rpsE-K23N, Δ24 | AACCAACGCGACCGTTACCATCGCCAACTACAGTCAGAGCTGTGAAGGAGAAAATACGA CCACCTTTAACGtTAGATACGCGGTTTACCG (SEQ ID NO: 1122) |
| rpsE-Δ24 | AACCAACGCGACCGTTACCATCGCCAACTACAGTCAGAGCTGTGAAGGAGAAAATACGA CCACCTTTAACtTTAGATACGCGGTTTACCG (SEQ ID NO: 1123) |
| rpsE-Δ17-19 | GTGAAGGAGAAAATACGACCACCTTTAACGGTTTTAGATACGCGGaTCAGCTTTTCCTG CAGTTCGCCAGCTTGTTTTTCGATGTGAGCC (SEQ ID NO: 1124) |

FIG. 35

| | |
|---|---|
| gRNA protospacers used in this study | |
| nicks 1 nucleotide from nonsense mutation in pTarget | Ttgctggccgtacattaata (SEQ ID NO: 1125) |
| nicks 11 nucleotide from nonsense mutation in pTarget | Acattaatacggctccgcag (SEQ ID NO: 1126) |
| nicks 56 nucleotide from nonsense mutation in pTarget | Tgatattgatttgctggtta (SEQ ID NO: 1127) |
| nicks 347 nucleotide from nonsense mutation in pTarget | Tgccttggtaggtccagcgg (SEQ ID NO: 1128) |
| Off-target gRNA (targets dbpA) | Gcatggaaacagttacaggg (SEQ ID NO: 1129) |
| Nicks after nucleotide position 77 of the genomic rpsE gene | GTATCTAAAACCGTTAAAGG (SEQ ID NO: 1130) |
| Nicks after nucleotide position 293 of the genomic rpsL gene | GTTCGTTACCACACCGTACG (SEQ ID NO: 1131) |
| rpsE-gRNA-A | GCTCTGACTGTAGTTGGCGA (SEQ ID NO: 1132) |
| rpsE-gRNA-B | AGCAGCGATCCAGAAAGCGA (SEQ ID NO: 1133) |
| rpsE-gRNA-C | GGTACCGGTATCATCGCCGG (SEQ ID NO: 1134) |
| rpsE-gRNA-D | TTCCACCAACCCGATCAACG (SEQ ID NO: 1135) |
| rpsE-gRNA-E | AATCCGTTGAAGAAATTCTG (SEQ ID NO: 1136) |

FIG. 36

| pTarget | Aacggatttacggctagctcagtcctaggtacaatgctagcgctagcaaagaggagaaa |
|---|---|
| | agatctatgcgctcacgcaactggtcccgcaccttgaccgaacgcagcggtggtaacgg |
| | cgcagtggcggttttcatggcttgttatgactgtttttttggggtacagtctatgcctc |
| | gcgcatccaagcagcaagcgcgttacgccgtgggtcgatgtttgatgttatggagcagc |
| | aacgatgttacgcagcagggcagtcgccctaaaacaaagttaaacattatgcgcgaagc |
| | ggtgatcgccgaagtatcgacccagctgtcggaggtggtgggggtcattgaacgtcacc |
| | tggaaccgaccttgctggccgtacattaatacggctccgcagtggatggcggcctgaag |
| | ccacacagtgatattgatttgctggttacggtgaccgtacgccttgatgaaacaacgcg |
| | ccgcgctttgatcaacgaccttttggaaacttcggcttcccctggagagagcgagattc |
| | tccgcgctgtagaagtcaccattgttgtgcacgacgacatcattccgtggcgttatcca |
| | gctaagcgcgaactgcaatttggagaatggcagcgcaatgacattcttgcgggtatctt |
| | cgagccagccacgatcgacattgatctggctatcttgctgacaaaagcacgcgaacata |
| | gcgttgccttggtaggtccagcggcggaggaactctttgatccggttcctgaacaggat |
| | ctgtttgaggcgctgaatgaaaccttaacgctgtggaactcgccgcccgactgggctgg |
| | cgatgagcgcaatgtagtgcttacgttgtcccgcatttggtacagcgcagtaaccggca |
| | aaatcgcgccgaaggatgtcgctgccgactgggcaatggagcgcctgccggcccagtat |
| | cagcccgtcattcttgaagctcgccaggcttatcttggacaagaagaagatcgcttggc |
| | ctcgcgcgcagatcagttggaagaatttgtccactacgtgaaaggcgagatcaccaagg |
| | tagtcggcaaataaggatcctaactcgagctcggtaccaaattccagaaaagaggcctc |
| | ccgaaaggggggcctttttttcgttttggtccgctgccaatgagacgacggggtcatcac |
| | ggctcatcatgcgccaaacaaatgtgtgcaatacacgctcggatgactgcatgatgacc |
| | gcactgactggggacagcagatccacctaagcctgtgagagaagcagacacccgacaga |
| | tcaaggcagttaactagtgcactgcagtacagcggccgctagcggagtgtatactggct |
| | tactatgttggcactgatgagggtgtcagtgaagtgcttcatgtggcaggagaaaaaag |
| | gctgcaccggtgcgtcagcagaatatgtgatacaggatatattccgcttcctcgctcac |
| | tgactcgctacgctcggtcgttcgactgcggcgagcggaaatggcttacgaacggggcg |
| | gagatttcctggaagatgccaggaagatacttaacagggaagtgagagggccgcggcaa |
| | agccgttttccataggctccgcccccctgacaagcatcacgaaatctgacgctcaaat |
| | cagtggtggcgaaacccgacaggactataaagataccaggcgtttcccctggcggctc |
| | cctcgtgcgctctcctgttcctgcctttcggtttaccggtgtcattccgctgttatggc |
| | cgcgtttgtctcattccacgcctgacactcagttccgggtaggcagttcgctccaagct |
| | ggactgtatgcacgaaccccccgttcagtccgaccgctgcgccttatccggtaactatc |
| | gtcttgagtccaacccggaaagacatgcaaaagcaccactggcagcagccactggtaat |

FIG. 36 (Cont.)

| | |
|---|---|
| | tgatttagaggagttagtcttgaagtcatgcgccggttaaggctaaactgaaaggacaa<br>gttttggtgactgcgctcctccaagccagttacctcggttcaaagagttggtagctcag<br>agaaccttcgaaaaaccgccctgcaaggcggttttttcgttttcagagcaagagattac<br>gcgcagaccaaaacgatctcaagaagatcatcttattaatcagataaaatattttgac<br>agctagctcagtcctaggtataatgctagcgttaataaggagaaggaaaagtatgggtc<br>aaagtagcgatgaagccaacgctcccgttgcagggcagtttgcgcttcccctgagtgcc<br>acctttggcttaggggatcgcgtacgcaagaaatctggtgccgcttggcagggtcaagt<br>cgtcggttggtattgcacaaaactcactcctgaaggctatgcggtagagtccgaatccc<br>acccaggctcagtgcaaatttatcctgtggctgcacttgaacgtgtggcctaaactgct<br>cccggtcacactagaaaataaaaacagccgtgcctctttctggcaacggctgttttat<br>ttattcaaccttaattaaggacagctattgtagataagtggggatactacgggtataaa<br>aaaacccgccggggcgggttttttacgttgcttcagagcggccgcccctgaattcgca<br>tctagatggtagagccacaaacagccggtacaagcaacgatctccaggaccatctgaat<br>catgcgcggatgacacgaactcacgacggcgatcacagacattaacccacagtacagac<br>actgcgacaacgtggcaattcgtcgcaataccgtctcactgaactggccgataattgca<br>gacg<br>BBa_J23110 promoter-*aadA* with a chain-terminating codon at position 106-L3S2P21 terminator-p15a origin of replication-Trimethoprim resistance cassette |
| pTarget2 | aacggatttacggctagctcagtcctaggtacaatgctagcgctagcaaagaggagaaa<br>agatctatgcgctcacgcaactggtcccgcaccttgaccgaacgcagcggtggtaacgg<br>cgcagtggcggttttcatggcttgttatgactgtttttttggggtacagtctatgcctc<br>gcgcatccaagcagcaagcgcgttacgccgtgggtcgatgtttgatgttatggagcagc<br>aacgatgttacgcagcagggcagtcgccctaaaacaaagttaaacattatgcgcgaagc<br>ggtgatcgccgaagtatcgacccagctgtcggaggtggtgggggtcattgaacgtcacc<br>tgtaaccgaccttgctggccgtacattaatacggctccgcagtggatggcggcctgaag<br>ccacacagtgatattgatttgctggttacggtgaccgtacgccttgatgaaacaacgcg<br>ccgcgctttgatcaacgaccttttggaaacttcggcttcccctggagagagcgagattc<br>tccgcgctgtagaagtcaccattgttgtgcacgacgacatcattccgtggcgttatcca<br>gctaagcgcgaactgcaatttggagaatggcagcgcaatgacattcttgcgggtatctt<br>cgagccagccacgatcgacattgatctggctatcttgctgacaaaagcacgcgaacata<br>gcgttgccttggtaggtccagcggcggaggaactctttgatccggttcctgaacaggat<br>ctgtttgaggcgctgaatgaaaccttaacgctgtggaactcgccgcccgactgggctgg<br>cgatgagcgcaatgtagtgcttacgttgtcccgcatttggtacagcgcagtaaccggca<br>aaatcgcgccgaaggatgtcgctgccgactgggcaatggagcgcctgccggcccagtat |

FIG. 36 (Cont.)

```
cagcccgtcattcttgaagctcgccaggcttatcttggacaagaagaagatcgcttggc
ctcgcgcgcagatcagttggaagaatttgtccactacgtgaaaggcgagatcaccaagg
tagtcggcaaataaggatcctaactcgagctcggtaccaaattccagaaaagaggcctc
ccgaaagggggggcctttttttcgttttggtccgctgccaatgagacgacggggtcatcac
ggctcatcatgcgccaaacaaatgtgtgcaatacacgctcggatgactgcatgatgacc
gcactgactggggacagcagatccacctaagcctgtgagagaagcagacacccgacaga
tcaaggcagttaactagtgcactgcagtacagcggccgctagcggagtgtatactggct
tactatgttggcactgatgagggtgtcagtgaagtgcttcatgtggcaggagaaaaaag
gctgcaccggtgcgtcagcagaatatgtgatacaggatatattccgcttcctcgctcac
tgactcgctacgctcggtcgttcgactgcggcgagcggaaatggcttacgaacggggcg
gagatttcctggaagatgccaggaagatacttaacagggaagtgagagggccgcggcaa
agccgttttttccataggctccgccccctgacaagcatcacgaaatctgacgctcaaat
cagtggtggcgaaacccgacaggactataaagataccaggcgtttccccctggcggctc
cctcgtgcgctctcctgttcctgcctttcggtttaccggtgtcattccgctgttatggc
cgcgtttgtctcattccacgcctgacactcagttccgggtaggcagttcgctccaagct
ggactgtatgcacgaaccccccgttcagtccgaccgctgcgccttatccggtaactatc
gtcttgagtccaacccggaaagacatgcaaaagcaccactggcagcagccactggtaat
tgatttagaggagttagtcttgaagtcatgcgccggttaaggctaaactgaaaggacaa
gttttggtgactgcgctcctccaagccagttacctcggttcaaagagttggtagctcag
agaaccttcgaaaaaccgccctgcaaggcggttttttcgttttcagagcaagagattac
gcgcagaccaaaacgatctcaagaagatcatcttattaatcagataaaatatttttgac
agctagctcagtcctaggtataatgctagcgttaataaggagaaggaaaagtatgggtc
aaagtagcgatgaagccaacgctcccgttgcagggcagtttgcgcttcccctgagtgcc
acctttggcttaggggatcgcgtacgcaagaaatctggtgccgcttggcagggtcaagt
cgtcggttggtattgcacaaaactcactcctgaaggctatgcggtagagtccgaatccc
acccaggctcagtgcaaatttatcctgtggctgcacttgaacgtgtggcctaaactgct
cccggtcacactagaaaataaaaacagccgtgcctctttctggcaacggctgtttttat
ttattcaaccttaattaaggacagctattgtagataagtggggatactacgggtataaa
aaaacccgccggggcgggttttttacgttgcttcagagcggccgcccctgaattcgca
tctagatggtagagccacaaacagccggtacaagcaacgatctccaggaccatctgaat
catgcgcggatgacacgaactcacgacggcgatcacagacattaacccacagtacagac
actgcgacaacgtggcaattcgtcgcaataccgtctcactgaactggccgataattgca
gacg
```

BBa_J23110 promoter-*aadA* with a chain-terminating codon at positions 98 and 106- L3S2P21 terminator-p15a origin of replication-Trimethoprim resistance cassette

FIG. 36 (Cont.)

| pEvolvR | tttatagctagctcagcccttggtacaatgctagc [insert 20 nucleotide gRNA protospacer] gttttagagctagaaatagcaagttaaaataaggctagtccgttatcaacttgaaaaag tggcaccgagtcggtgctttttttgaagcttgggcccgaacaaaaaactcatctcagaag aggatctgaatagcgccgtcgaccatcatcatcatcattgagtttaaacggactcc agcttggctgttttggcggatgagagaagattttcagcctgatacagattaaatcagaa cgcagaagcggtctgataaaacagaatttgcctggcggcagtagcgcggtggtcccacc tgaccccatgccgaactcagaagtgaaacgccgtagcgccgatggtagtgtggggactc cccatgcgagagtagggaactgccaggcatcaaataaaacgaaaggctcagtcgaaaga ctgggcctttcgttttatctgttgtttgtcggtgaacgacagggctgccaaaccagatg tcaacacagctacaacgttaagacccactttcacatttaagttgttttctaatccgca tatgatcaattcaaggccgaataagaaggctggctctgcaccttggtgatcaaataatt cgatagcttgtcgtaataatggcggcatactatcagtagtaggtgtttccctttcttct ttagcgacttgatgctcttgatcttccaatacgcaacctaaagtaaaatgccccacagc gctgagtgcatataatgcattctctagtgaaaaaccttgttggcataaaaaggctaatt gattttcgagagtttcatactgttttctgtaggccgtgtacctaaatgtacttttgct ccatcgcgatgacttagtaaagcacatctaaaacttttagcgttattacgtaaaaaatc ttgccagcttccccttctaaagggcaaaagtgagtatggtgcctatctaacatctcaa tggctaaggcgtcgagcaaagcccgcttatttttacatgccaatacaatgtaggctgc tctacacctagcttctgggcgagtttacggggttgttaaaccttcgattccgacctcatt aagcagctctaatgcgctgttaatcactttactttatctaatctagacatcattaatt cctaattttgttgacactctatcgttgatagagttattttaccactccctatcagtga tagagaaaagaattcaaaagatctaaagaggagaaaagatctatg [Insert Cas9 variant] tggttctagtgaaacccgggaacaagtgagtcggccacccctgaaggtggatcagggg gtagcggatcg [Insert DNA Polymerase variant] taataatggcctcggtaccaaagacgaacaataagacgctgaaaagcgtctttttcgt tttggtccgctgagcagttacagagatgttacgaaccactagtgcactgcagtacagtg ttacaaccaattaaccaattctgattagaaaaactcatcgagcatcaaatgaaactgca atttattcatatcaggattatcaataccatattttgaaaaagccgtttctgtaatgaa ggagaaaactcaccgaggcagttccataggatggcaagatcctggtatcggtctgcgat tccgactcgtccaacatcaatacaacctattaatttcccctcgtcaaaataaggttat caagtgagaaatcaccatgagtgacgactgaatccggtgagaatggcaaaagcttatgc atttctttccagacttgttcaacaggccagccattacgctcgtcatcaaaatcactcgc atcaaccaaaccgttattcattcgtgattgcgcctgagcgaggcgaaatacgcgatcgc |

FIG. 36 (Cont.)

```
tgttaaaaggacaattacaaacaggaatcgaatgcaaccggcgcaggaacactgccagc
gcatcaacaatattttcacctgaatcaggatattcttctaatacctggaatgctgtttt
cccggggatcgcagtggtgagtaaccatgcatcatcaggagtacggataaaatgcttga
tggtcggaagaggcataaattccgtcagccagtttagtctgaccatctcatctgtaaca
tcattggcaacgctacctttgccatgtttcagaaacaactctggcgcatcgggcttccc
atacaatcgatagattgtcgcacctgattgcccgacattatcgcgagcccatttatacc
catataaatcagcatccatgttggaatttaatcgcggcctggagcaagacgtttcccgt
tgaatatggctcataacaccccttgtattactgtttatgtaagcagacagttttattgt
tcatgatgatatattttttatcttgtgcaatgtaacatcagagattttgagacacaacgt
ggctttgttgaataaatcgaacttttgctgagttgaaggatcaggagttcatgaccaaa
atcccttaacgtgagttttcgttccactgagcgtcagacccgtagaaaagatcaaagg
atcttcttgagatccttttttctgcgcgtaatctgctgcttgcaaacaaaaaaaccac
cgctaccagcggtggtttgtttgccggatcaagagctaccaactcttttccgaaggta
actggcttcagcagagcgcagataccaaatactgtccttctagtgtagccgtagttagg
ccaccacttcaagaactctgtagcaccgcctacatacctcgctctgctaatcctgttac
cagtggctgctgccagtggcgataagtcgtgtcttaccgggttggactcaagacgatag
ttaccggataaggcgcagcggtcgggctgaacggggggttcgtgcacacagcccagctt
ggagcgaacgacctacaccgaactgagatacctacagcgtgagctatgagaaagcgcca
cgcttcccgaagggagaaaggcggacaggtatccggtaagcggcagggtcggaacagga
gagcgcacgagggagcttccaggggaaacgcctggtatctttatagtcctgtcgggtt
tcgccacctctgacttgagcgtcgatttttgtgatgctcgtcagggggcggagcctat
ggaaaaacgccagcaacgcggcctttttacggttcctggccttttgctggccttttgct
cacatgttctttcctgcgttatcccctgattctgtggataaccgtattaccgcctttga
gtgagctgataccgctcgccgcagccgaacgaccgagcgcagcgagtcagtgagcgagg
aagcggaagagcgcctgatgcggtattttctccttacgcatctgtgcggtatttcacac
cgcaatggtgcactctcagtacaatctgctctgatgccgcatagttaagccagtataca
ctccgctatcgctacgtgactgggtcatggctgcgccccgacacccgccaacacccgct
gacgcgccctgacgggcttgtctgctcccggcatccgcttacagacaagctgtgaccttt
ctccgggagctgcatgtgtcagaggttttcaccgtcatcaccgaaacgcgcgaggcagc
tgcggtaaagctcatcagcgtggtcgtgaagcgattcacagatgtctgcctgttcatcc
gcgtccagctcgttgagtttctccagaagcgttaatgtctggcttctgataaagcgggc
catgttaagggcggttttttcctgtttggtcactgatgcctccgtgtaagggggatttc
tgttcatcccctgaattcgcatctagactgaactggccgataattgcagacgaacggatt
tactttacagctagctcagtcctaggtattatgctagcgctagcaaagaggagaaaaga
tctatggagaaaaaaatcactggatataccaccgttgatatatcccaatggcatcgtaa
```

FIG. 36 (Cont.)

| | |
|---|---|
| | agaacatttgaggcatttcagtcagttgctcaatgtacctataaccagaccgttcagc<br>tggatattacggccttttaaagaccgtaaagaaaaataagcacaagttttaaccggcc<br>tttattcacattcttgcccgcctgatgaatgctcatccggaatttcgtatggcaatgaa<br>agacggtgagctggtgatatgggatagtgttcaccccttgttacaccgttttccatgagc<br>aaactgaaacgttttcatcgctctggagtgaataccacgacgatttccggcagtttcta<br>cacatatattcgcaagatgtggcgtgttacggtgaaaacctggcctatttccctaaagg<br>gtttattgagaatatgttttcgtttcagccaatccctgggtgagtttcaccagttttg<br>atttaaacgtggccaatatggacaacttcttcgccccgttttcaccatgggcaaatat<br>tatacgcaaggcgacaaggtgctgatgccgctggcgattcaggttcatcatgccgtttg<br>tgatggcttccatgtcggcagaatgcttaatgaattacaacagtactgcgatgagtggc<br>agggcggggcgtaaggatcctaactcgagctcggtaccaaattccagaaaagaggcctc<br>ccgaaagggggcctttttcgttttggtccgctgccaaaccagatgtcaacacagcta<br>caacg<br>J23115 promoter-[Insert 20 nucleotide gRNA protospacer]-Single gRNA body-TrrnB terminator-TetR, pTet, BBa_B0034 RBS-[Insert Cas9 variant]-23 amino acid linker-[Insert DNA Polymerase variant]-L3S2P55 terminator-Kanamycin resistance cassette-pBR322 origin of replication |
| pEvolvR-Phi29 | tttatagctagctcagcccttggtacaatgctagc [insert 20 nucleotide gRNA protospacer]<br>gttttagagctagaaatagcaagttaaaataaggctagtccgttatcaacttgaaaaag<br>tggcaccgagtcggtgcttttttgaagcttgggcccgaacaaaaaactcatctcagaag<br>aggatctgaatagcgccgtcgaccatcatcatcatcatcattgagtttaaacggactcc<br>agcttggctgttttggcggatgagagaagattttcagcctgatacagattaaatcagaa<br>cgcagaagcggtctgataaaacagaatttgcctggcggcagtagcgcggtggtcccacc<br>tgacccatgccgaactcagaagtgaaacgccgtagcgccgatggtagtgtggggactc<br>cccatgcgagagtagggaactgccaggcatcaaataaaacgaaaggctcagtcgaaaga<br>ctgggcctttcgttttatctgttgtttgtcggtgaacgacagggctgccaaaccagatg<br>tcaacacagctacaacgttaagacccactttcacatttaagttgtttttctaatccgca<br>tatgatcaattcaaggccgaataagaaggctggctctgcaccttggtgatcaaataatt<br>cgatagcttgtcgtaataatggcggcatactatcagtagtaggtgtttccctttcttct<br>ttagcgacttgatgctcttgatcttccaatacgcaacctaaagtaaaatgccccacagc<br>gctgagtgcatataatgcattctctagtgaaaaaccttgttggcataaaaaggctaatt<br>gattttcgagagtttcatactgttttctgtaggccgtgtacctaaatgtacttttgct<br>ccatcgcgatgacttagtaaagcacatctaaaactttagcgttattacgtaaaaaatc |

FIG. 36 (Cont.)

ttgccagcttttccccttctaaagggcaaaagtgagtatggtgcctatctaacatctcaa
tggctaaggcgtcgagcaaagcccgcttattttttacatgccaatacaatgtaggctgc
tctacacctagcttctgggcgagtttacggggttgttaaaccttcgattccgacctcatt
aagcagctctaatgcgctgttaatcactttacttttatctaatctagacatcattaatt
cctaattttgttgacactctatcgttgatagagttattttaccactccctatcagtga
tagagaaaagaattcaaaagatctaaagaggagaaaagatctatg [Insert Phi29 variant]
ggttctagtgaaaccccgggaacaagtgagtcggccacccctgaaggtggatcaggggg
tagcggatccgttcagatcccgcagaacccgctgattctggttgacggatctagttacc
tgtaccgtgcttaccatgctttcccgcctttgaccaattctgctggtgaacctacggga
gctatgtacggagttctgaatatgttgcgttctttaattatgcagtacaagcctaccca
cgctgctgttgttttcgatgctaaaggtaagacgttccgcgacgagttattcgagcact
ataagtctcaccgtcctccgatgcctgatgacttacgcgctcagattgagccgctgcat
gctatggtgaaggctatgggtttacctcttttggctgtcagcggtgttgaggctgatga
tgtcattggcaccttagctcgtgaggctgagaaggctggtcgccctgttttgatttcta
ccggtgacaaggacatggctcaattggttaccccgaacatcaccctgatcaacaccatg
accaacacgattctgggtcctgaggaagttgttaacaaatatggtgttcctccggagtt
gattattgactttcttgctcttatgggcgattcttcagacaatatcccgggtgttccag
gtgttggagagaagactgctcaagctctgcttcaggggtctgggtggtttggacaccctt
tacgctgaaccggagaagatcgccggtctgtcttttcgcggtgctaagaccatggctgc
taaactggaacagaataaggaggtcgcatacctgtcttatcaattggctaccatcaaga
cggatgtggagttagaacttacgtgcgagcagcttgaggttcaacagcctgctgctgag
gaactgctgggtcttttaagaaatacgaatttaagcgttggaccgccgacgttgaggc
tggtaagtggctgcaagctaaggtgctaagccggctgctaaaccgcaagaaacgagtg
tcgctgatgaggctccggaggttaccgctaccgttatcGGTTCTagtgaaaccccggga
acaagtgagtcggccacccctgaaggtggatcaggggggtagcGGATCCgacaagaagta
ttctatcggactggctatcgggactaatagcgtcgggtgggccgtgatcactgacgagt
acaaggtgccctctaagaagttcaaggtgctcgggaacaccgaccggcattccatcaag
aaaaatctgatcggagctctcctctttgattcaggggaaaccgctgaagcaacccgcct
caagcggactgctagacggcggtacaccaggaggaagaaccggatttgttaccttcaag
agatattctccaacgaaatggcaaaggtcgacgacagcttcttccataggctggaagaa
tcattcctcgtggaagaggataagaagcatgaacggcatcccatcttcggtaatatcgt
cgacgaggtggcctatcacgagaaataccccaaccatctaccatcttcgcaaaaagctgg
tggactcaaccgacaaggcagacctccggcttatctacctggccctggcccacatgatc

FIG. 36 (Cont.)

```
aagttcagaggccacttcctgatcgagggcgacctcaatcctgacaatagcgatgtgga
taaactgttcatccagctggtgcagacttacaaccagctctttgaagagaaccccatca
atgcaagcggagtcgatgccaaggccattctgtcagcccggctgtcaaagagccgcaga
cttgagaatcttatcgctcagctgccgggtgaaaagaaaaatggactgttcgggaacct
gattgctctttcacttgggctgactcccaatttcaagtctaatttcgacctggcagagg
atgccaagctgcaactgtccaaggacacctatgatgacgatctcgacaacctcctggcc
cagatcggtgaccaatacgccgacctttccttgctgctaagaatctttctgacgccat
cctgctgtctgacattctccgcgtgaacactgaaatcaccaaggcccctctttcagctt
caatgattaagcggtatgatgagcaccaccaggacctgaccctgcttaaggcactcgtc
cggcagcagcttccggagaagtacaaggaaatcttctttgaccagtcaaagaatggata
cgccggctacatcgacggaggtgcctcccaagaggaattttataagtttatcaaaccta
tccttgagaagatggacggcaccgaagagctcctcgtgaaactgaatcgggaggatctg
ctgcggaagcagcgcactttcgacaatgggagcattccccaccagatccatcttgggga
gcttcacgccatccttcggcgccaagaggacttctaccccttccttaaggacaacaggg
agaagattgagaaaattctcactttccgcatcccctactacgtgggacccctcgccaga
ggaaatagccggtttgcttggatgaccagaaagtcagaagaaactatcactccctggaa
cttcgaagaggtggtggacaagggagccagcgctcagtcattcatcgaacggatgacta
acttcgataagaaccctccccaatgagaaggtcctgccgaaacattccctgctctacgag
tactttaccgtgtacaacgagctgaccaaggtgaaatatgtcaccgaagggatgaggaa
gcccgcattcctgtcaggcgaacaaaagaaggcaattgtggaccttctgttcaagacca
atagaaaggtgaccgtgaagcagctgaaggaggactatttcaagaaaattgaatgcttc
gactctgtggagattagcggggtcgaagatcggttcaacgcaagcctgggtacttacca
tgatctgcttaagatcatcaaggacaaggattttctggacaatgaggagaacgaggaca
tccttgaggacattgtcctgactctcactctgttcgaggaccgggaaatgatcgaggag
aggcttaagacctacgcccatctgttcgacgataaagtgatgaagcaacttaaacggag
aagatataccggatggggacgcctagccgcaaactcatcaacggaatccgggacaaac
agagcggaaagaccattcttgatttccttaagagcgacggattcgctaatcgcaacttc
atgcaacttatccatgatgattccctgacctttaaggaggacatccagaaggcccaagt
gtctggacaaggtgactcactgcacgagcatatcgcaaatctggctggttcacccgcta
ttaagaagggtattctccagaccgtgaaagtcgtggacgagctggtcaaggtgatgggt
cgccataaaccagagaacattgtcatcgagatggccagggaaaaccagactacccagaa
gggacagaagaacagcagggagcggatgaaaagaattgaggaagggattaaggagctcg
ggtcacagatccttaaagagcacccggtggaaaacacccagcttcagaatgagaagctc
tatctgtactaccttcaaaatggacgcgatatgtatgtggaccaagagcttgatatcaa
caggctctcagactacgacgtggaccatatcgtccctcagagcttcctcgcagacgact
```

FIG. 36 (Cont.)

```
caattgacaataaggtgctgactcgctcagacaagaaccggggaaagtcagataacgtg
ccctcagaggaagtcgtgaaaaagatgaagaactattggcgccagcttctgaacgcaaa
gctgatcactcagcggaagttcgacaatctcactaaggctgagagggcggactgagcg
aactggacaaagcaggattcattaaacggcaacttgtggagactcggcagattactaaa
catgtcgcccaaatccttgactcacgcatgaataccaagtacgacgaaaacgacaaact
tatccgcgaggtgaaggtgattaccctgaagtccaagctggtcagcgatttcagaaagg
actttcaattctacaaagtgcgggagatcaataactatcatcatgctcatgacgcatat
ctgaatgccgtggtgggaaccgccctgatcaagaagtacccagcactggaaagcgagtt
cgtgtacggagactacaaggtctacgacgtgcgcaagatgattgccaaatctgagcagg
agatcggaaaggccaccgcaaagtacttcttctacagcaacatcatgaatttcttcaag
accgaaatcacccttgcaaacggtgagatccggaaggcgccgctcatcgagactaatgg
ggagactggcgaaatcgtgtgggacaagggcagagatttcgctaccgtgcgcaaagtgc
tttctatgcctcaagtgaacatcgtgaagaaaaccgaggtgcaaaccggaggcttttct
aaggaatcaatcctccccaagcgcaactccgacaagctcattgcaaggaagaaggattg
ggaccctaagaagtacggcggattcgattcaccaactgtggcttattctgtcctggtcg
tggctaaggtggaaaaaggaaagtctaagaagctcaagagcgtgaaggaactgctgggt
atcaccattatggagcgcagctccttcgagaagaacccaattgactttctcgaagccaa
aggttacaaggaagtcaagaaggaccttatcatcaagctcccaaagtatatagcctgttcg
aactggagaatgggcggaagcggatgctcgcctccgctggcgaacttcagaagggtaat
gagctggctctcccctccaagtacgtgaatttcctctaccttgcaagccattacgagaa
gctgaaggggagccccgaggacaacgagcaaaagcaactgtttgtggagcagcataagc
attatctggacgagatcattgagcagatttccgagttttctaaacgcgtcattctcgct
gatgccaacctcgataaagtccttagcgcatacaataagcacagagacaaaccaattcg
ggagcaggctgagaatatcatccacctgttcaccctcaccaatcttggtgcccctgccg
cattcaagtacttcgacaccaccatcgaccggaaacgctatacctccaccaaagaagtg
ctggacgccacccctcatccaccagagcatcaccggactttacgaaactcggattgacct
ctcacagctcggagggattaatggcctcggtaccaaagacgaacaataagacgctgaa
aagcgtctttttcgttttggtccgctgagcagttacagagatgttacgaaccactagt
gcactgcagtacagtgttacaaccaattaaccaattctgattagaaaaactcatcgagc
atcaaatgaaactgcaatttattcatatcaggattatcaataccatatttttgaaaaag
ccgtttctgtaatgaaggagaaaactcaccgaggcagttccataggatggcaagatcct
ggtatcggtctgcgattccgactcgtccaacatcaatacaacctattaatttccccctcg
tcaaaaataaggttatcaagtgagaaatcaccatgagtgacgactgaatccggtgagaa
tggcaaaagcttatgcatttctttccagacttgttcaacaggccagccattacgctcgt
catcaaaatcactcgcatcaaccaaaccgttattcattcgtgattgcgcctgagcgagg
```

FIG. 36 (Cont.)

```
cgaaatacgcgatcgctgttaaaaggacaattacaaacaggaatcgaatgcaaccggcg
caggaacactgccagcgcatcaacaatattttcacctgaatcaggatattcttctaata
cctggaatgctgttttcccggggatcgcagtggtgagtaaccatgcatcatcaggagta
cggataaaatgcttgatggtcggaagaggcataaattccgtcagccagtttagtctgac
catctcatctgtaacatcattggcaacgctacctttgccatgtttcagaaacaactctg
gcgcatcgggcttcccatacaatcgatagattgtcgcacctgattgcccgacattatcg
cgagcccatttatacccatataaatcagcatccatgttggaatttaatcgcggcctgga
gcaagacgtttcccgttgaatatggctcataacaccccttgtattactgtttatgtaag
cagacagttttattgttcatgatgatatattttatcttgtgcaatgtaacatcagaga
ttttgagacacaacgtggctttgttgaataaatcgaacttttgctgagttgaaggatca
ggagttcatgaccaaaatcccttaacgtgagttttcgttccactgagcgtcagaccccg
tagaaaagatcaaaggatcttcttgagatcctttttttctgcgcgtaatctgctgcttg
caaacaaaaaaaccaccgctaccagcggtggtttgtttgccggatcaagagctaccaac
tcttttccgaaggtaactggcttcagcagagcgcagataccaaatactgtccttctag
tgtagccgtagttaggccaccacttcaagaactctgtagcaccgcctacatacctcgct
ctgctaatcctgttaccagtggctgctgccagtggcgataagtcgtgtcttaccgggtt
ggactcaagacgatagttaccggataaggcgcagcggtcgggctgaacggggggttcgt
gcacacagcccagcttggagcgaacgacctacaccgaactgagatacctacagcgtgag
ctatgagaaagcgccacgcttcccgaagggagaaaggcggacaggtatccggtaagcgg
cagggtcggaacaggagagcgcacgagggagcttccagggggaaacgcctggtatcttt
atagtcctgtcgggtttcgccacctctgacttgagcgtcgattttgtgatgctcgtca
ggggggcggagcctatggaaaaacgccagcaacgcggccttttacggttcctggcctt
ttgctggccttttgctcacatgttctttcctgcgttatcccctgattctgtggataacc
gtattaccgcctttgagtgagctgataccgctcgccgcagccgaacgaccgagcgcagc
gagtcagtgagcgaggaagcggaagagcgcctgatgcggtattttctccttacgcatct
gtgcggtatttcacaccgcaatggtgcactctcagtacaatctgctctgatgccgcata
gttaagccagtatacactccgctatcgctacgtgactgggtcatggctgcgccccgaca
cccgccaacacccgctgacgcgccctgacgggcttgtctgctcccggcatccgcttaca
gacaagctgtgaccttctccgggagctgcatgtgtcagaggttttcaccgtcatcaccg
aaacgcgcgaggcagctgcggtaaagctcatcagcgtggtcgtgaagcgattcacagat
gtctgcctgttcatccgcgtccagctcgttgagtttctccagaagcgttaatgtctggc
ttctgataaagcgggccatgttaagggcggttttttcctgtttggtcactgatgcctcc
gtgtaagggggatttctgttcatcccctgaattcgcatctagactgaactggccgataat
tgcagacgaacggatttactttacagctagctcagtcctaggtattatgctagcgctag
caaagaggagaaaagatctatggagaaaaaaatcactggatataccaccgttgatatat
```

FIG. 36 (Cont.)

| | |
|---|---|
| | cccaatggcatcgtaaagaacattttgaggcatttcagtcagttgctcaatgtacctat aaccagaccgttcagctggatattacggccttttttaaagaccgtaaagaaaaataagca caagttttaaccggcctttattcacattcttgcccgcctgatgaatgctcatccggaat ttcgtatggcaatgaaagacggtgagctggtgatatgggatagtgttcacccttgttac accgttttccatgagcaaactgaaacgttttcatcgctctggagtgaataccacgacga tttccggcagtttctacacatatattcgcaagatgtggcgtgttacggtgaaaacctgg cctatttccctaaagggtttattgagaatatgttttttcgtttcagccaatccctgggtg agtttcaccagttttgatttaaacgtggccaatatggacaacttcttcgcccccgtttt caccatgggcaaatattatacgcaaggcgacaaggtgctgatgccgctggcgattcagg ttcatcatgccgtttgtgatggcttccatgtcggcagaatgcttaatgaattacaacag tactgcgatgagtggcagggcgggcgtaaggatcctaactcgagctcggtaccaaatt ccagaaaagaggcctcccgaaggggggcctttttttcgttttggtccgctgccaaacca gatgtcaacacagctacaacg<br>J23115 promoter-[Insert 20 nucleotide gRNA protospacer]-Single gRNA body-TrmB terminator-TetR, pTet, BBa_B0034 RBS-[Insert Phi29 variant]-PolI(1-324)-enCas9-L3S2P55 terminator-Kanamycin resistance cassette-pBR322 origin of replication |
| pEvolvR expressing two gRNAs | tttatagctagctcagcccttggtacaatgctagc [insert 20 nucleotide gRNA protospacer] gttttagagctagaaatagcaagttaaaataaggctagtccgttatcaacttgaaaaag tggcaccgagtcggtgctttttttctcggtaccaaattccagaaaagaggcctcccgaa agggggggccttttttttcgttttggtccgctgccaaaccagatgtcaacacagctacaacg tttatagctagctcagcccttggtacaatgctagc [insert 20 nucleotide gRNA protospacer] gttttagagctagaaatagcaagttaaaataaggctagtccgttatcaacttgaaaaag tggcaccgagtcggtgctttttttt gaagcttgggcccgaacaaaaactcatctcagaagaggatctgaatagcgccgtcgacc atcatcatcatcatcattgagtttaaacggactccagcttggctgttttggcggatgag agaagattttcagcctgatacagattaaatcagaacgcagaagcggtctgataaaacag aatttgcctggcggcagtagcgcggtggtcccacctgaccccatgccgaactcagaagt gaaacgccgtagcgccgatggtagtgtggggactcccatgcgagagtagggaactgcc aggcatcaaataaaacgaaaggctcagtcgaaagactgggcctttcgttttatctgttg tttgtcggtgaacgacagggctgccaaaccagatgtcaacacagctacaacgttaagac ccactttcacatttaagttgttttttctaatccgcatatgatcaattcaaggccgaataa gaaggctggctctgcaccttggtgatcaaataattcgatagcttgtcgtaataatggcg |

FIG. 36 (Cont.)

```
gcatactatcagtagtaggtgtttcccttctttctttagcgacttgatgctcttgatct
tccaatacgcaacctaaagtaaaatgccccacagcgctgagtgcatataatgcattctc
tagtgaaaaaccttgttggcataaaaaggctaattgattttcgagagtttcatactgtt
tttctgtaggccgtgtacctaaatgtacttttgctccatcgcgatgacttagtaaagca
catctaaaacttttagcgttattacgtaaaaaatcttgccagctttccccttctaaagg
gcaaaagtgagtatggtgcctatctaacatctcaatggctaaggcgtcgagcaaagccc
gcttattttttacatgccaatacaatgtaggctgctctacacctagcttctgggcgagt
ttacgggttgttaaaccttcgattccgacctcattaagcagctctaatgcgctgttaat
cactttacttttatctaatctagacatcattaattcctaattttttgttgacactctatc
gttgatagagttattttaccactccctatcagtgatagagaaaagaattcaaaagatct
aaagaggagaaaagatctatg [Insert Cas9 variant]
tggttctagtgaaaccccgggaacaagtgagtcggccacccctgaaggtggatcagggg
gtagcggatcc [Insert DNA Polymerase variant]
taataatggcctcggtaccaaagacgaacaataagacgctgaaaagcgtctttttttcgt
tttggtccgctgagcagttacagagatgttacgaaccactagtgcactgcagtacagtg
ttacaaccaattaaccaattctgattagaaaaaactcatcgagcatcaaatgaaactgca
atttattcatatcaggattatcaataccatatttttgaaaaagccgtttctgtaatgaa
ggagaaaactcaccgaggcagttccataggatggcaagatcctggtatcggtctgcgat
tccgactcgtccaacatcaatacaacctattaatttcccctcgtcaaaaataaggttat
caagtgagaaatcaccatgagtgacgactgaatccggtgagaatggcaaaagcttatgc
atttcttccagacttgttcaacaggccagccattacgctcgtcatcaaaatcactcgc
atcaaccaaaccgttattcattcgtgattgcgcctgagcgaggcgaaatacgcgatcgc
tgttaaaaggacaattacaaacaggaatcgaatgcaaccggcgcaggaacactgccagc
gcatcaacaatattttcacctgaatcaggatattcttctaatacctggaatgctgtttt
cccggggatcgcagtggtgagtaaccatgcatcatcaggagtacggataaaatgcttga
tggtcggaagaggcataaaattccgtcagccagtttagtctgaccatctcatctgtaaca
tcattggcaacgctacctttgccatgtttcagaaacaactctggcgcatcgggcttccc
atacaatcgatagattgtcgcacctgattgcccgacattatcgcgagcccatttatacc
catataaatcagcatccatgttggaatttaatcgcggcctggagcaagacgtttcccgt
tgaatatggctcataacaccccttgtattactgtttatgtaagcagacagttttattgt
tcatgatgatatatttttatcttgtgcaatgtaacatcagagatttttgagacacaacgt
ggctttgttgaataaatcgaacttttgctgagttgaaggatcaggagttcatgaccaaa
atcccttaacgtgagttttcgttccactgagcgtcagacccgtagaaaagatcaaagg
atcttcttgagatcctttttttctgcgcgtaatctgctgcttgcaaacaaaaaaaccac
cgctaccagcggtggtttgtttgccggatcaagagctaccaactctttttccgaaggta
```

FIG. 36 (Cont.)

```
actggcttcagcagagcgcagataccaaatactgtccttctagtgtagccgtagttagg
ccaccacttcaagaactctgtagcaccgcctacatacctcgctctgctaatcctgttac
cagtggctgctgccagtggcgataagtcgtgtcttaccgggttggactcaagacgatag
ttaccggataaggcgcagcggtcgggctgaacgggggttcgtgcacacagcccagctt
ggagcgaacgacctacaccgaactgagatacctacagcgtgagctatgagaaagcgcca
cgcttcccgaagggagaaaggcggacaggtatccggtaagcggcaggggtcggaacagga
gagcgcacgagggagcttccagggggaaacgcctggtatctttatagtcctgtcgggtt
tcgccacctctgacttgagcgtcgattttgtgatgctcgtcagggggcggagcctat
ggaaaaacgccagcaacgcggcctttttacggttcctggccttttgctggccttttgct
cacatgttctttcctgcgttatcccctgattctgtggataaccgtattaccgcctttga
gtgagctgataccgctcgccgcagccgaacgaccgagcgcagcgagtcagtgagcgagg
aagcggaagagcgcctgatgcggtattttctccttacgcatctgtgcggtatttcacac
cgcaatggtgcactctcagtacaatctgctctgatgccgcatagttaagccagtataca
ctccgctatcgctacgtgactgggtcatggctgcgccccgacacccgccaacacccgct
gacgcgcctgacgggcttgtctgctcccggcatccgcttacagacaagctgtgaccttt
ctccgggagctgcatgtgtcagaggttttcaccgtcatcaccgaaacgcgcgaggcagc
tgcggtaaagctcatcagcgtggtcgtgaagcgattcacagatgtctgcctgttcatcc
gcgtccagctcgttgagtttctccagaagcgttaatgtctggcttctgataaagcgggc
catgttaagggcggttttttcctgtttggtcactgatgcctccgtgtaagggggatttc
tgttcatccctgaattcgcatctagactgaactggccgataattgcagacgaacggatt
tactttacagctagctcagtcctaggtattatgctagcgctagcaaagaggagaaaaga
tctatggagaaaaaaatcactggatataccaccgttgatatatcccaatggcatcgtaa
agaacattttgaggcatttcagtcagttgctcaatgtacctataaccagaccgttcagc
tggatattacggcctttttaaagaccgtaaagaaaaataagcacaagttttaaccggcc
tttattcacattcttgcccgcctgatgaatgctcatccggaatttcgtatggcaatgaa
agacggtgagctggtgatatgggatagtgttcaccttgttacaccgttttccatgagc
aaactgaaacgttttcatcgctctggagtgaataccacgacgatttccggcagtttcta
cacatatattcgcaagatgtggcgtgttacggtgaaaacctggcctatttccctaaagg
gtttattgagaatatgttttcgtttcagccaatccctgggtgagtttcaccagttttg
atttaaacgtggccaatatggacaacttcttcgccccgttttcaccatgggcaaatat
```

FIG. 36 (Cont.)

```
tatacgcaaggcgacaaggtgctgatgccgctggcgattcaggttcatcatgccgtttg
tgatggcttccatgtcggcagaatgcttaatgaattacaacagtactgcgatgagtggc
agggcggggcgtaaggatcctaactcgagctcggtaccaaattccagaaaagaggcctc
ccgaaagggggccttttttcgttttggtccgctgccaaaccagatgtcaacacagcta
caacg
```

J23115 promoter-[Insert 20 nucleotide gRNA protospacer]-Single gRNA body-TrmB terminator-TetR, pTet, BBa_B0034 RBS-[Insert Cas9 variant]-23 amino acid linker-[Insert DNA Polymerase variant]-L3S2P55 terminator-Kanamycin resistance cassette-pBR322 origin of replication

FIG. 37

| | Amino acid sequences of EvolvR parts used in this study |
|---|---|
| nCas9 | DKKYSIGLAIGTNSVGWAVITDEYKVPSKKFKVLGNTDRHSIKKNLIGALLFDSGETAE ATRLKRTARRRYTRRKNRICYLQEIFSNEMAKVDDSFFHRLEESFLVEEDKKHERHPIF GNIVDEVAYHEKYPTIYHLRKKLVDSTDKADLRLIYLALAHMIKFRGHFLIEGDLNPDN SDVDKLFIQLVQTYNQLFEENPINASGVDAKAILSARLSKSRRLENLIAQLPGEKKNGL FGNLIALSLGLTPNFKSNFDLAEDAKLQLSKDTYDDDLDNLLAQIGDQYADLFLAAKNL SDAILLSDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNGSIPHQI HLGELHAILRRQEDFYPFLKDNREKIEKILTFRIPYYVGPLARGNSRFAWMTRKSEETI TPWNFEEVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVEDRFNASL GTYHDLLKIIKDKDFLDNEENEDILEDIVLTLTLFEDREMIEERLKTYAHLFDDKVMKQ LKRRRYTGWGRLSRKLINGIRDKQSGKTILDFLKSDGFANRNFMQLIHDDSLTFKEDIQ KAQVSGQGDSLHEHIANLAGSPAIKKGILQTVKVVDELVKVMGRHKPENIVIEMARENQ TTQKGQKNSRERMKRIEEGIKELGSQILKEHPVENTQLQNEKLYLYYLQNGRDMYVDQE LDINRLSDYDVDHIVPQSFLKDDSIDNKVLTRSDKNRGKSDNVPSEEVVKKMKNYWRQL LNAKLITQRKFDNLTKAERGGLSELDKAGFIKRQLVETRQITKHVAQILDSRMNTKYDE NDKLIREVKVITLKSKLVSDFRKDFQFYKVREINNYHHAHDAYLNAVVGTALIKKYPKL ESEFVYGDYKVYDVRKMIAKSEQEIGKATAKYFFYSNIMNFFKTEITLANGEIRKRPLI ETNGETGEIVWDKGRDFATVRKVLSMPQVNIVKKTEVQTGGFSKESILPKRNSDKLIAR KKDWDPKKYGGFDSPTVAYSVLVVAKVEKGKSKKLKSVKELLGITIMERSSFEKNPIDF LEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRD KPIREQAENIIHLFTLTNLGAPAAFKYFDTTIDRKRYTSTKEVLDATLIHQSITGLYET RIDLSQLGGD (SEQ ID NO: 1142) |
| enCas9 | DKKYSIGLAIGTNSVGWAVITDEYKVPSKKFKVLGNTDRHSIKKNLIGALLFDSGETAE ATRLKRTARRRYTRRKNRICYLQEIFSNEMAKVDDSFFHRLEESFLVEEDKKHERHPIF GNIVDEVAYHEKYPTIYHLRKKLVDSTDKADLRLIYLALAHMIKFRGHFLIEGDLNPDN SDVDKLFIQLVQTYNQLFEENPINASGVDAKAILSARLSKSRRLENLIAQLPGEKKNGL FGNLIALSLGLTPNFKSNFDLAEDAKLQLSKDTYDDDLDNLLAQIGDQYADLFLAAKNL SDAILLSDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNGSIPHQI HLGELHAILRRQEDFYPFLKDNREKIEKILTFRIPYYVGPLARGNSRFAWMTRKSEETI TPWNFEEVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVEDRFNASL GTYHDLLKIIKDKDFLDNEENEDILEDIVLTLTLFEDREMIEERLKTYAHLFDDKVMKQ LKRRRYTGWGRLSRKLINGIRDKQSGKTILDFLKSDGFANRNFMQLIHDDSLTFKEDIQ KAQVSGQGDSLHEHIANLAGSPAIKKGILQTVKVVDELVKVMGRHKPENIVIEMARENQ TTQKGQKNSRERMKRIEEGIKELGSQILKEHPVENTQLQNEKLYLYYLQNGRDMYVDQE LDINRLSDYDVDHIVPQSFLADDSIDNKVLTRSDKNRGKSDNVPSEEVVKKMKNYWRQL LNAKLITQRKFDNLTKAERGGLSELDKAGFIKRQLVETRQITKHVAQILDSRMNTKYDE NDKLIREVKVITLKSKLVSDFRKDFQFYKVREINNYHHAHDAYLNAVVGTALIKKYPAL ESEFVYGDYKVYDVRKMIAKSEQEIGKATAKYFFYSNIMNFFKTEITLANGEIRKAPLI ETNGETGEIVWDKGRDFATVRKVLSMPQVNIVKKTEVQTGGFSKESILPKRNSDKLIAR KKDWDPKKYGGFDSPTVAYSVLVVAKVEKGKSKKLKSVKELLGITIMERSSFEKNPIDF LEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRD KPIREQAENIIHLFTLTNLGAPAAFKYFDTTIDRKRYTSTKEVLDATLIHQSITGLYET RIDLSQLGGD (SEQ ID NO: 1143) |

FIG. 37 (Cont.)

| PolI1M | VQIPQNPLILVDGSSYLYRAYHAFPPLTNSAGEPTGAMYGVLNMLRSLIMQYKPTHAAV<br>VFDAKGKTFRDELFEHYKSHRPPMPDDLRAQIEPLHAMVKAMGLPLLAVSGVEADDVIG<br>TLAREAEKAGRPVLISTGDKDMAQLVTPNITLINTMTNTILGPEEVVNKYGVPPELIID<br>FLALMGDSSDNIPGVPGVGEKTAQALLQGLGGLDTLYAEPEKIAGLSFRGAKTMAAKLE<br>QNKEVAYLSYQLATIKTDVELELTCEQLEVQQPAAEELLGLFKKYEFKRWTADVEAGKW<br>LQAKGAKPAAKPQETSVADEAPEVTATVISYDNYVTILDEETLKAWIAKLEKAPVFAFD<br>TETDSLDNISANLVGLSFAIEPGVAAYIPVAHDYLDAPDQISRERALELLKPLLEDEKA<br>LKVGQNLKYARGILANYGIELRGIAFDTMLESYILNSVAGRHDMDSLAERWLKHKTITF<br>EEIAGKGKNQLTFNQIALEEAGRYAAEDADVTLQLHLKMWPDLQKHKGPLNVFENIEMP<br>LVPVLSRIERNGVKIDPKVLHNHSEELTLRLAELEKKAHEIAGEEFNLSSTKQLQTILF<br>EKQGIKPLKKTPGGAPSTSEEVLEELALDYPLPKVILEYRGLAKLKSTYTDKLPLMINP<br>KTGRVHTSYHQAVTATGRLSSTDPNLQNIPVRNEEGRRIRQAFIAPEDYVIVSADYSQI<br>ELRIMAHLSRDKGLLTAFAEGKDIHRATAAEVFGLPLETVTSEQRRSAKAINFGLIYGM<br>SAFGLARQLNIPRKEAQKYMDLYFERYPGVLEYMERTRAQAKEQGYVETLDGRRLYLPD<br>IKSSNGARRAAAERAAINAPMQGTAADIIKRAMIAVDAWLQAEQPRVRMIMQVHDELVF<br>EVHKDDVDAVAKQIHQLMENCTRLDVPLLVEVGSGENWDQAH (SEQ ID NO:<br>1144) |
| --- | --- |
| PolI2M | VQIPQNPLILVDGSSYLYRAYHAFPPLTNSAGEPTGAMYGVLNMLRSLIMQYKPTHAAV<br>VFDAKGKTFRDELFEHYKSHRPPMPDDLRAQIEPLHAMVKAMGLPLLAVSGVEADDVIG<br>TLAREAEKAGRPVLISTGDKDMAQLVTPNITLINTMTNTILGPEEVVNKYGVPPELIID<br>FLALMGDSSDNIPGVPGVGEKTAQALLQGLGGLDTLYAEPEKIAGLSFRGAKTMAAKLE<br>QNKEVAYLSYQLATIKTDVELELTCEQLEVQQPAAEELLGLFKKYEFKRWTADVEAGKW<br>LQAKGAKPAAKPQETSVADEAPEVTATVISYDNYVTILDEETLKAWIAKLEKAPVFAFD<br>TETDSLDNISANLVGLSFAIEPGVAAYIPVAHDYLDAPDQISRERALELLKPLLEDEKA<br>LKVGQNLKYARGILANYGIELRGIAFDTMLESYILNSVAGRHDMDSLAERWLKHKTITF<br>EEIAGKGKNQLTFNQIALEEAGRYAAEDADVTLQLHLKMWPDLQKHKGPLNVFENIEMP<br>LVPVLSRIERNGVKIDPKVLHNHSEELTLRLAELEKKAHEIAGEEFNLSSTKQLQTILF<br>EKQGIKPLKKTPGGAPSTSEEVLEELALDYPLPKVILEYRGLAKLKSTYTDKLPLMINP<br>KTGRVHTSYHQAVTATGRLSSTDPNLQNIPVRNEEGRRIRQAFIAPEDYVIVSADYSQN<br>ELRIMAHLSRDKGLLTAFAEGKDIHRATAAEVFGLPLETVTSEQRRSAKAINFGLIYGM<br>SAFGLARQLNIPRKEAQKYMDLYFERYPGVLEYMERTRAQAKEQGYVETLDGRRLYLPD<br>IKSSNGARRAAAERAAINAPMQGTAADIIKRAMIAVDAWLQAEQPRVRMIMQVHDELVF<br>EVHKDDVDAVAKQIHQLMENCTRLDVPLLVEVGSGENWDQAH (SEQ ID NO:<br>1145) |
| PolI3M | VQIPQNPLILVDGSSYLYRAYHAFPPLTNSAGEPTGAMYGVLNMLRSLIMQYKPTHAAV<br>VFDAKGKTFRDELFEHYKSHRPPMPDDLRAQIEPLHAMVKAMGLPLLAVSGVEADDVIG<br>TLAREAEKAGRPVLISTGDKDMAQLVTPNITLINTMTNTILGPEEVVNKYGVPPELIID<br>FLALMGDSSDNIPGVPGVGEKTAQALLQGLGGLDTLYAEPEKIAGLSFRGAKTMAAKLE<br>QNKEVAYLSYQLATIKTDVELELTCEQLEVQQPAAEELLGLFKKYEFKRWTADVEAGKW<br>LQAKGAKPAAKPQETSVADEAPEVTATVISYDNYVTILDEETLKAWIAKLEKAPVFAFD<br>TETDSLDNISANLVGLSFAIEPGVAAYIPVAHDYLDAPDQISRERALELLKPLLEDEKA<br>LKVGQNLKYARGILANYGIELRGIAFDTMLESYILNSVAGRHDMDSLAERWLKHKTITF<br>EEIAGKGKNQLTFNQIALEEAGRYAAEDADVTLQLHLKMWPDLQKHKGPLNVFENIEMP<br>LVPVLSRIERNGVKIDPKVLHNHSEELTLRLAELEKKAHEIAGEEFNLSSTKQLQTILF<br>EKQGIKPLKKTPGGAPSTSEEVLEELALDYPLPKVILEYRGLAKLKSTYTDKLPLMINP<br>KTGRVHTSYHQAVTATGRLSSTDPNLQNIPVRNEEGRRIRQAFIAPEDYVIVSADYSQN<br>ELRIMAHLSRDKGLLTAFAEGKDIHRATAAEVFGLPLETVTSEQRRSAKRINFGLIYGM<br>SAFGLARQLNIPRKEAQKYMDLYFERYPGVLEYMERTRAQAKEQGYVETLDGRRLYLPD |

FIG. 37 (Cont.)

| | |
|---|---|
| | IKSSNGARRAAAERAAINAPMQGTAADIIKRAMIAVDAWLQAEQPRVRMIMQVHDELVF EVHKDDVDAVAKQIHQLMENCTRLDVPLLVEVGSGENWDQAH (SEQ ID NO: 1146) |
| PolI5M | VQIPQNPLILVDGSSYLYRAYHAFPPLTNSAGEPTGAMYGVLNMLRSLIMQYKPTHAAV VFDAKGKTFRDELFEHYKSHRPPMPDDLRAQIEPLHAMVKAMGLPLLAVSGVEADDVIG TLAREAEKAGRPVLISTGDKDMAQLVTPNITLINTMTNTILGPEEVVNKYGVPPELIID FLALMGDSSDNIPGVPGVGEKTAQALLQGLGGLDTLYAEPEKIAGLSFRGAKTMAAKLE QNKEVAYLSYQLATIKTDVELELTCEQLEVQQPAAEELLGLFKKYEFKRWTADVEAGKW LQAKGAKPAAKPQETSVADEAPEVTATVISYDNYVTILDEETLKAWIAKLEKAPVFAFD TETDSLDNISANLVGLSFAIEPGVAAYIPVAHDYLDAPDQISRERALELLKPLLEDEKA LKVGQNLKYARGILANYGIELRGIAFDTMLESYILNSVAGRHDMDSLAERWLKHKTITF EEIAGKGKNQLTFNQIALEEAGRYAAEDADVTLQLHLKMWPDLQKHKGPLNVFENIEMP LVPVLSRIERNGVKIDPKVLHNHSEELTLRLAELEKKAHEIAGEEFNLSSTKQLQTILF EKQGIKPLKKTPGGAPSTSEEVLEELALDYPLPKVILEYRGLAKLKSTYTDKLPLMINP KTGRVHTSYHQAVTATGRLSSTDPNLQNIPVRNEEGRRIRQAFIAPEDYVIVSADYSQN ELRIMAHLSRDKGLLTAFAEGKDIHRATAAEVYGLPLETVTSEQRRSAKRINFGLIYGM SAFGLARQLNIPRKEAQKYMDLYFERYHGVLEYMERTRAQAKEQGYVETLDGRRLYLPD IKSSNGARRAAAERAAINAPMQGTAADIIKRAMIAVDAWLQAEQPRVRMIMQVHDELVF EVHKDDVDAVAKQIHQLMENCTRLDVPLLVEVGSGENWDQAH (SEQ ID NO: 1147) |
| PolI3M-TBD | VQIPQNPLILVDGSSYLYRAYHAFPPLTNSAGEPTGAMYGVLNMLRSLIMQYKPTHAAV VFDAKGKTFRDELFEHYKSHRPPMPDDLRAQIEPLHAMVKAMGLPLLAVSGVEADDVIG TLAREAEKAGRPVLISTGDKDMAQLVTPNITLINTMTNTILGPEEVVNKYGVPPELIID FLALMGDSSDNIPGVPGVGEKTAQALLQGLGGLDTLYAEPEKIAGLSFRGAKTMAAKLE QNKEVAYLSYQLATIKTDVELELTCEQLEVQQPAAEELLGLFKKYEFKRWTADVEAGKW LQAKGAKPAAKPQETSVADEAPEVTATVISYDNYVTILDEETLKAWIAKLEKAPVFAFD TETDSLDNISANLVGLSFAIEPGVAAYIPVAHDYLDAPDQISRERALELLKPLLEDEKA LKVGQNLKYARGILANYGIELRGIAFDTMLESYILNSVAGRHDMDSLAERWLKHKTITF EEIAGKGKNQLTFNQIALEEAGRYAAEDADVTLQLHLKMWPDLQKHKGPLNVFENIEMP LVPVLSRIERNGVKIDPKVLHNHSEELTLRLAELEKKATETFGSWYQPKGGTEMFCHPR TGKPLPKYPRIKTPKVGGIFKKPKNKAQREGREPCELDTREYVAGAPYTPVEHVVFNLS STKQLQTILFEKQGIKPLKKTPGGAPSTSEEVLEELALDYPLPKVILEYRGLAKLKSTY TDKLPLMINPKTGRVHTSYHQAVTATGRLSSTDPNLQNIPVRNEEGRRIRQAFIAPEDY VIVSADYSQNELRIMAHLSRDKGLLTAFAEGKDIHRATAAEVFGLPLETVTSEQRRSAK RINFGLIYGMSAFGLARQLNIPRKEAQKYMDLYFERYPGVLEYMERTRAQAKEQGYVET LDGRRLYLPDIKSSNGARRAAAERAAINAPMQGTAADIIKRAMIAVDAWLQAEQPRVRM IMQVHDELVFEVHKDDVDAVAKQIHQLMENCTRLDVPLLVEVGSGENWDQAH (SEQ ID NO: 1148) |
| Phi29 (N62D) | KHMPRKMYSCDFETTTKVEDCRVWAYGYMNIEDHSEYKIGNSLDEFMAWVLKVQADLYF HDLKFDGAFIINWLERNGFKWSADGLPNTYNTIISRMGQWYMIDICLGYKGKRKIHTVI YDSLKKLPFPVKKIAKDFKLTVLKGDIDYHKERPVGYKITPEEYAYIKNDIQIIAEALL IQFKQGLDRMTAGSDSLKGFKDIITTKKFKKVFPTLSLGLDKEVRYAYRGGFTWLNDRF KEKEIGEGMVFDVNSLYPAQMYSRLLPYGEPIVFEGKYVWDEDYPLHIQHIRCEFELKE GYIPTIQIKRSRFYKGNEYLKSSGGEIADLWLSNVDLELMKEHYDLYNVEYISGLKFKA TTGLFKDFIDKWTYIKTTSEGAIKQLAKLMLNSLYGKFASNPDVTGKVPYLKENGALGF RLGEEETKDPVYTPMGVFITAWARYTTITAAQACYDRIIYCDTDSIHLTGTEIPDVIKD IVDPKKLGYWAHESTFKRAKYLRQKTYIQDIYMKEVDGKLVEGSPDDYTDIKFSVKCAG MTDKIKKEVTFENFKVGFSRKMKPKPVQVPGGVVLVDDTFTIK (SEQ ID NO: 1149) |

FIG. 37 (Cont.)

| Phi29 (N62D, L384R) | KHMPRKMYSCDFETTTKVEDCRVWAYGYMNIEDHSEYKIGNSLDEFMAWVLKVQADLYF HDLKFDGAFIINWLERNGFKWSADGLPNTYNTIISRMGQWYMIDICLGYKGKRKIHTVI YDSLKKLPFPVKKIAKDFKLTVLKGDIDYHKERPVGYKITPEEYAYIKNDIQIIAEALL IQFKQGLDRMTAGSDSLKGFKDIITTKKFKKVFPTLSLGLDKEVRYAYRGGFTWLNDRF KEKEIGEGMVFDVNSLYPAQMYSRLLPYGEPIVFEGKYVWDEDYPLHIQHIRCEFELKE GYIPTIQIKRSRFYKGNEYLKSSGGEIADLWLSNVDLELMKEHYDLYNVEYISGLKFKA TTGLFKDFIDKWTYIKTTSEGAIKQLAKRMLNSLYGKFASNPDVTGKVPYLKENGALGF RLGEEETKDPVYTPMGVFITAWARYTTITAAQACYDRIIYCDTDSIHLTGTEIPDVIKD IVDPKKLGYWAHESTFKRAKYLRQKTYIQDIYMKEVDGKLVEGSPDDYTDIKFSVKCAG MTDKIKKEVTFENFKVGFSRKMKPKPVQVPGGVVLVDDTFTIK (SEQ ID NO: 1150) |
|---|---|
| Phi29 (N62D) | KHMPRKRYSCDFETTTKVEDCRVWAYGYMNIEDHSEYKIGNSLDEFMAWALKVQADLYF HDLKFDGAFIINWLERNGFKWSADGLPNTYNTIISRTGQWYMIDICLGYKGKRKIHTVI YDSLKKLPFPVKKIAKDFKLTVLKGDIDYHKERPVGYKITPEEYAYIKNDIQIIAEALL IQFKQGLDRMTAGSDSLKDFKDIITTKKFKKVFPTLSLGLDKKVRYAYRGGFTWLNDRF KEKEIGEGMVFDVNSLYPAQMYSRLLPYGEPIVFEGKYVWDEDYPLHIQHIRCEFELKE GYIPTIQIKRSRFYKGNEYLKSSGGEIADLWLSNVDLELMKEHYDLYNVEYISGLKFKA TTGLFKDFIDKWTYIKTTSEGAIKQLAKLMLNSLYGKFASNPDVTGKVPYLKENGALGF RLGEEETKDPVYTPMGVFITAWARYTTITAAQACYDRIIYCDTDSIHLTGTEIPDVIKD IVDPKKLGYWAHESTFKRAKYLRPKTYIQDIYMKEVDGKLVEGSPDDYTDIKLSVKCAG MTDKIKKEVTFENFKVGFSRKMKPKPVQVPGGVVLVDDTFTIK (SEQ ID NO: 1151) |
| iPhi29 (N62D, L384R) | KHMPRKRYSCDFETTTKVEDCRVWAYGYMNIEDHSEYKIGNSLDEFMAWALKVQADLYF HDLKFDGAFIINWLERNGFKWSADGLPNTYNTIISRTGQWYMIDICLGYKGKRKIHTVI YDSLKKLPFPVKKIAKDFKLTVLKGDIDYHKERPVGYKITPEEYAYIKNDIQIIAEALL IQFKQGLDRMTAGSDSLKDFKDIITTKKFKKVFPTLSLGLDKKVRYAYRGGFTWLNDRF KEKEIGEGMVFDVNSLYPAQMYSRLLPYGEPIVFEGKYVWDEDYPLHIQHIRCEFELKE GYIPTIQIKRSRFYKGNEYLKSSGGEIADLWLSNVDLELMKEHYDLYNVEYISGLKFKA TTGLFKDFIDKWTYIKTTSEGAIKQLAKRMLNSLYGKFASNPDVTGKVPYLKENGALGF RLGEEETKDPVYTPMGVFITAWARYTTITAAQACYDRIIYCDTDSIHLTGTEIPDVIKD IVDPKKLGYWAHESTFKRAKYLRPKTYIQDIYMKEVDGKLVEGSPDDYTDIKLSVKCAG MTDKIKKEVTFENFKVGFSRKMKPKPVQVPGGVVLVDDTFTIK (SEQ ID NO: 1152) |
| Phi29 SSB | ENTNIVKATFDTETLEGQIKIFNAQTGGGQSFKNLPDGTIIEANAIAQYKQVSDTYGDA KEETVTTIFAADGSLYSAISKTVAEAASDLIDLVTRHKLETFKVKVVQGTSSKGNVFFS LQLSL (SEQ ID NO: 1153) |

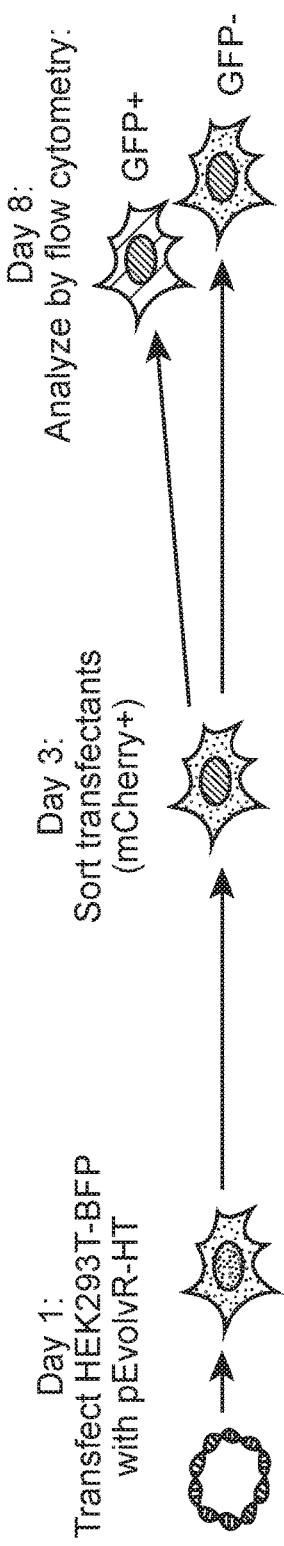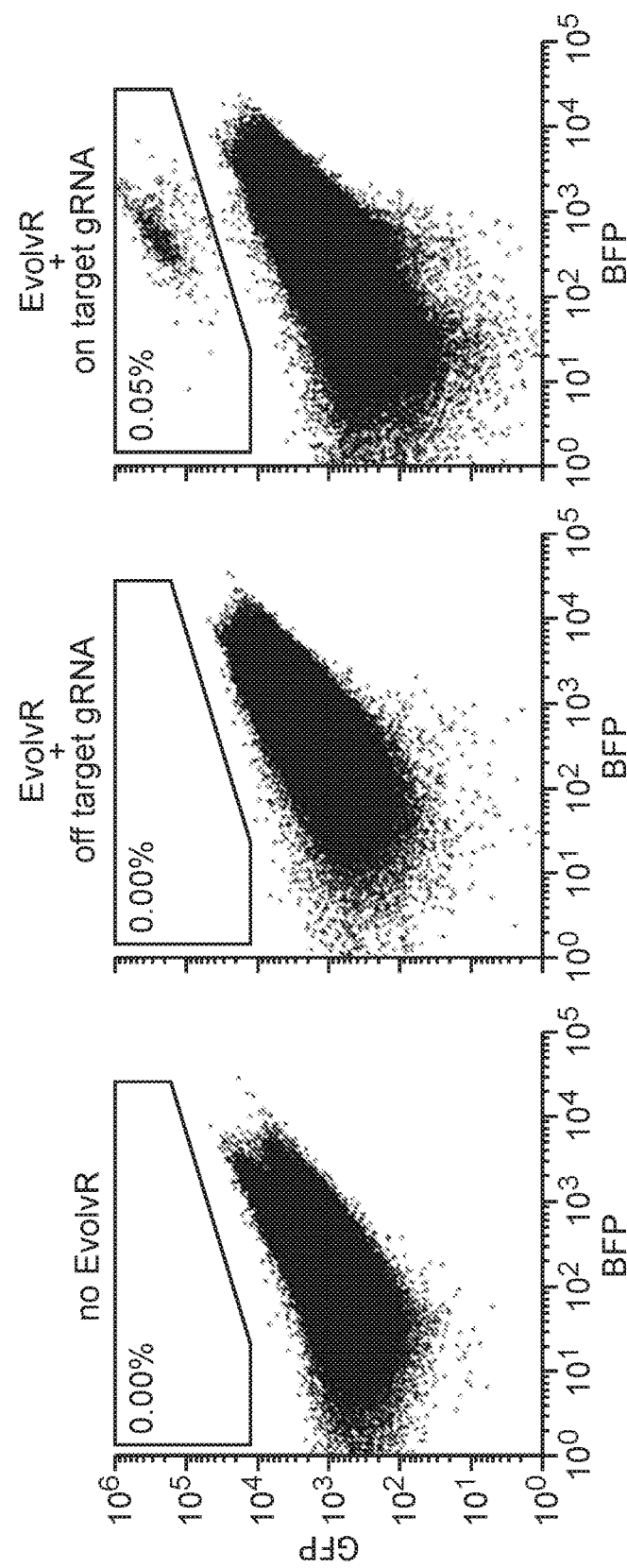
FIG. 39C
FIG. 39D

FIG. 40A
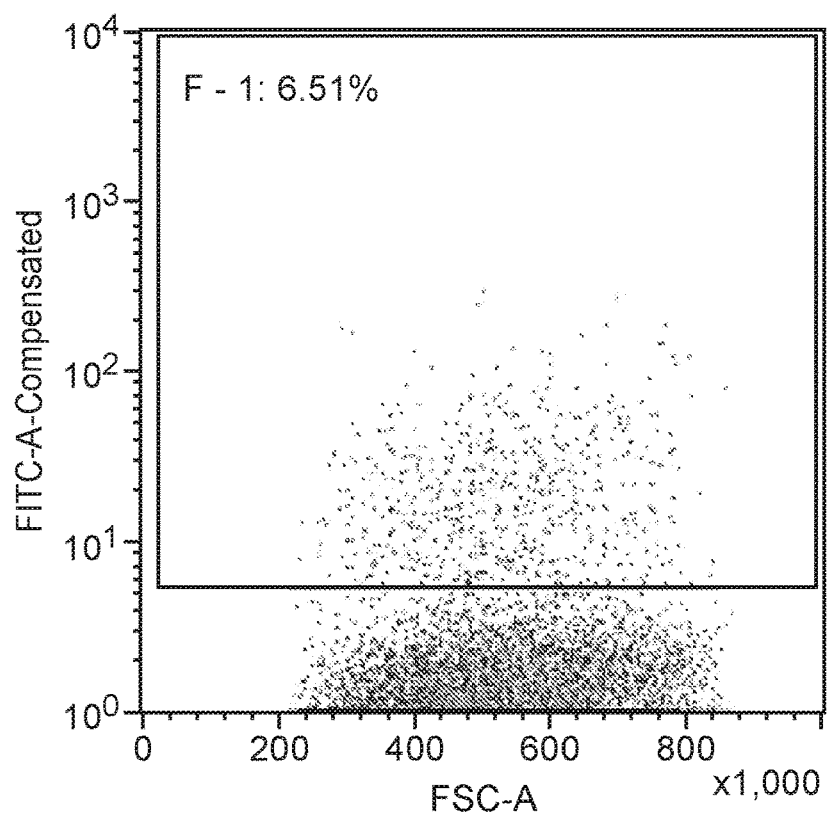
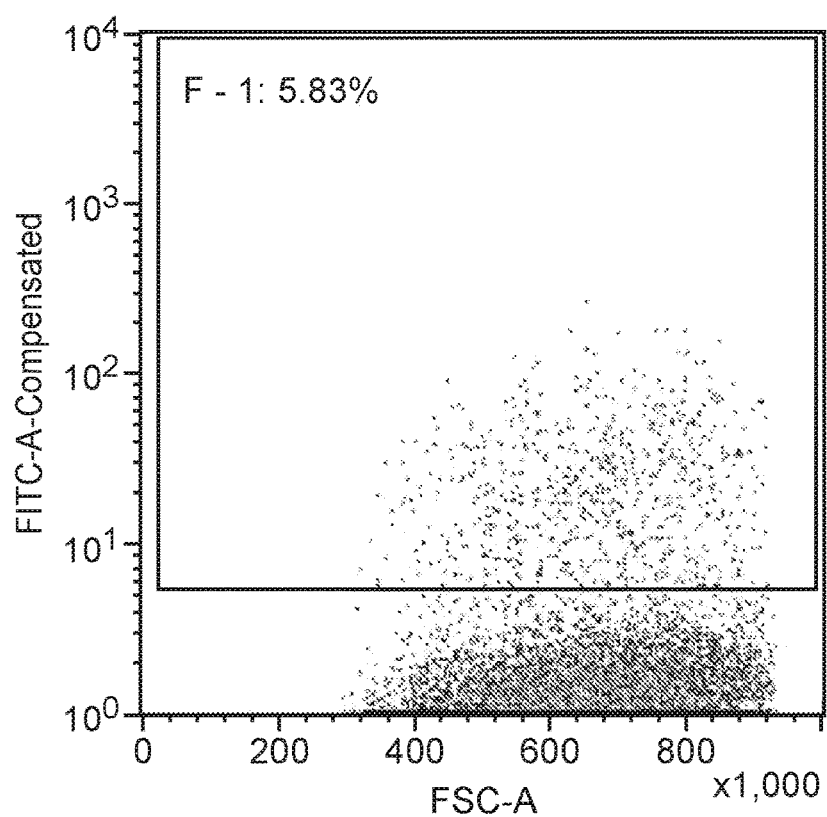

FIG. 40B
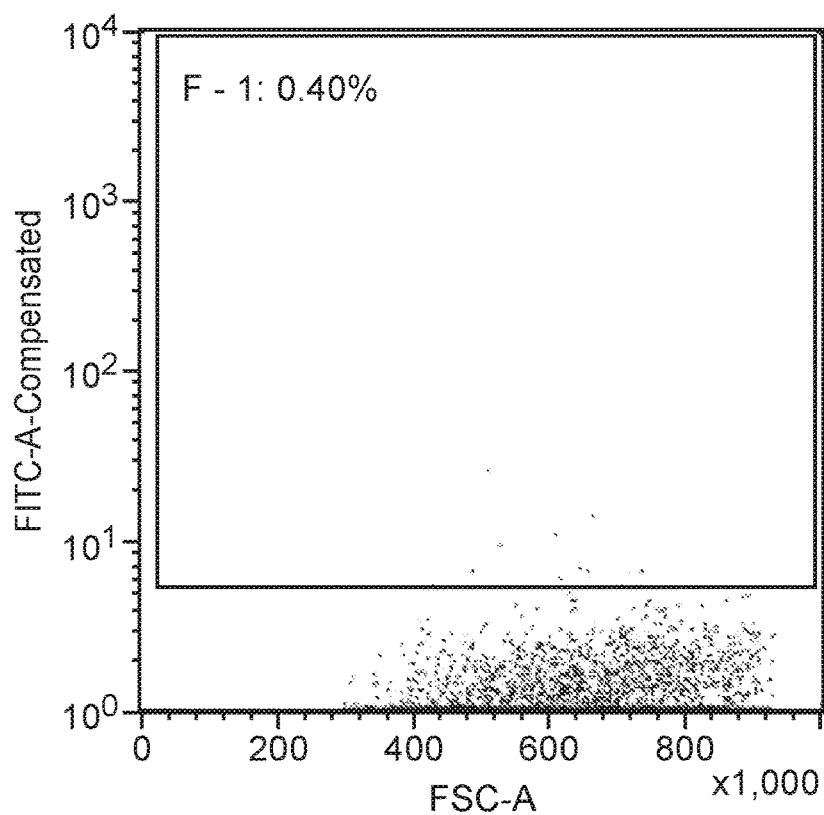
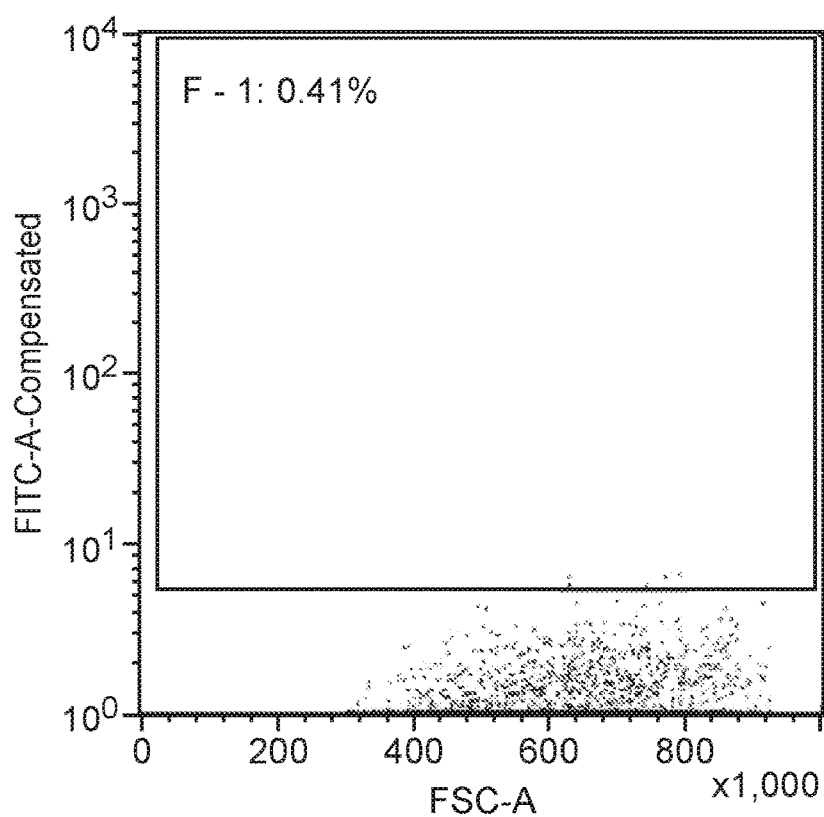

FIG. 40C
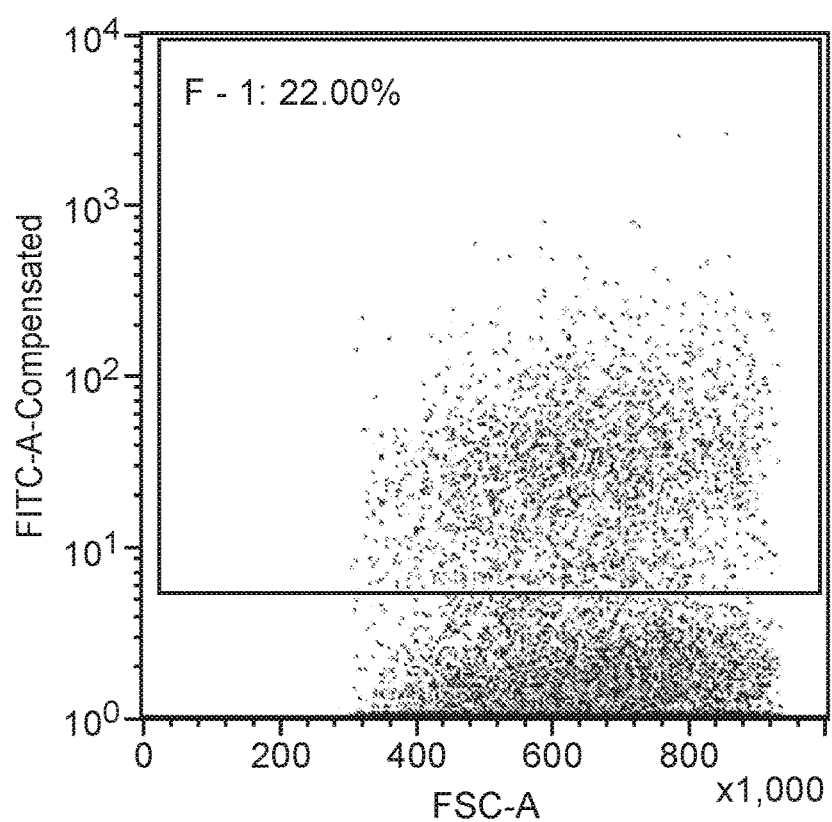
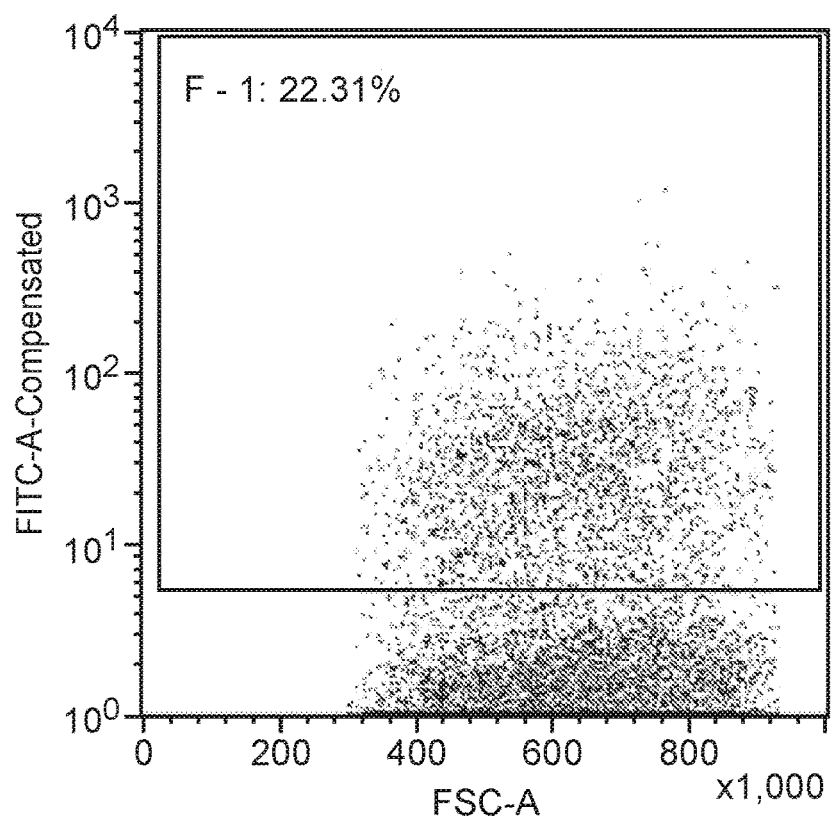

FIG. 40D
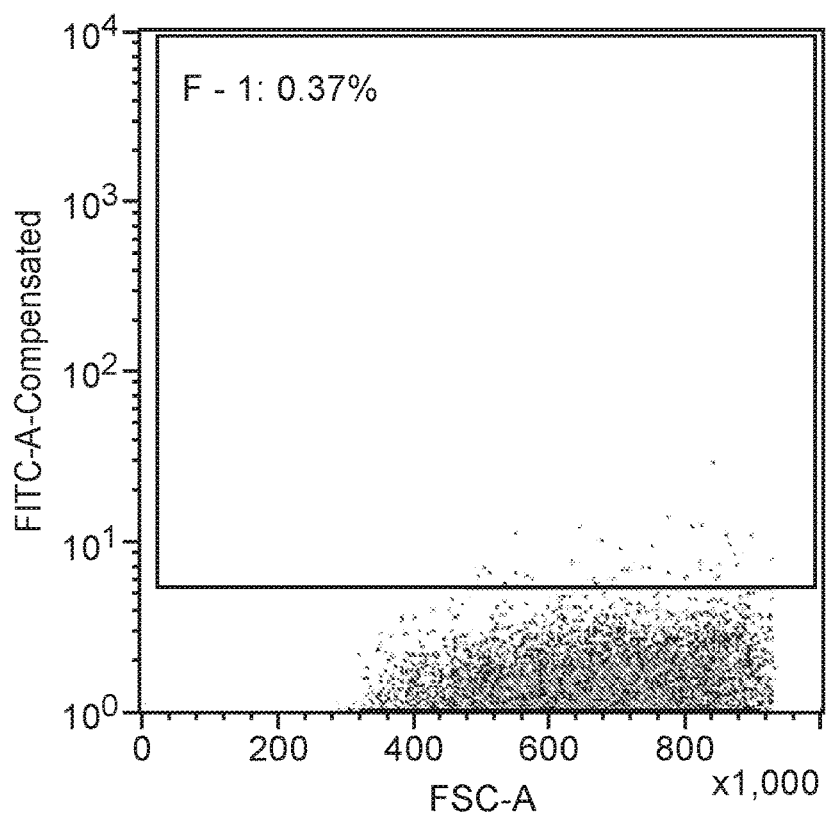
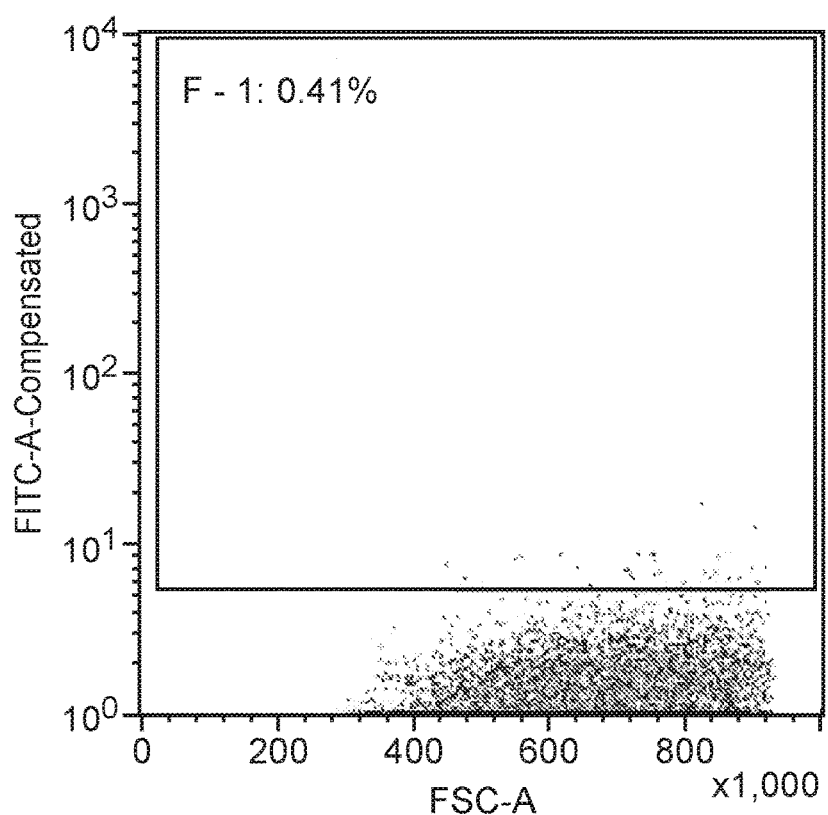

RNA-GUIDED ENDONUCLEASE FUSION POLYPEPTIDES AND METHODS OF USE THEREOF

CROSS-REFERENCE

This application is a division of U.S. patent application Ser. No. 16/641,950, now U.S. Pat. No. 11,649,442, filed Feb. 25, 2020, which is a U.S. National Phase Application of PCT Application No. PCT/US2018/049766, filed Sep. 6, 2018, which claims the benefit of U.S. Provisional Patent Application No. 62/556,127, filed Sep. 8, 2017, and U.S. Provisional Patent Application No. 62/662,043, filed Apr. 24, 2018, which applications are incorporated herein by reference in their entirety.

INCORPORATION BY REFERENCE OF SEQUENCE LISTING PROVIDED AS A TEXT FILE SEQUENCE LISTING XML FILE

A Sequence Listing is provided herewith as a Sequence Listing XML, "BERK-363DIV_SEQ_LIST" created on Aug. 28, 2023 and having a size of 2,173,363 bytes. The contents of the Sequence Listing XML are incorporated by reference herein in their entirety.

INTRODUCTION

Directed evolution is a powerful discovery approach that isolates genetic material with desirable properties from a library of sequence variants. However, the sequence space that can be explored is limited by the efficiency of synthesizing and transforming a genetic library. This requirement for efficient transformation rates has confined directed evolution to only a few model organisms. The ability to program a cell to localize increased mutagenesis at user-defined loci would remove the need to transform a synthesized library of nucleic acids; unfortunately, current in vivo targeted mutagenesis platforms are either confined to targeting a set locus in a specific organism or have a narrow and biased editing window at user-defined loci.

There is a need in the art for compositions and methods for mutagenizing a target DNA.

SUMMARY

The present disclosure provides a fusion polypeptide comprising: a) an enzymatically active RNA-guided endonuclease that introduces a single-stranded break in a target DNA; and b) an error-prone DNA polymerase. The present disclosure provides a system comprising: a) a fusion polypeptide of the present disclosure; and b) a guide RNA. The present disclosure provides a cell comprising a fusion polypeptide of the present disclosure, or a system of the present disclosure. The present disclosure provides a method of mutagenizing a target polynucleotide.

BRIEF DESCRIPTION OF THE DRAWINGS

FIG. 5A-5F provides amino acid sequences of *Streptococcus pyogenes* Cas9 (FIG. 5A; SEQ ID NO: 1219) and variants of *Streptococcus pyogenes* Cas9 (FIG. 5B-5F). FIG. 5B: SEQ ID NO: 1220; FIG. 5C: SEQ ID NO:1221; FIG. 5D: SEQ ID NO:1222; FIG. 5E: SEQ ID NO:1223; and FIG. 5F: SEQ ID NO:1210.

FIG. 6 provides an amino acid sequence of *Staphylococcus aureus* Cas9 (SEQ ID No.: 1224).

FIG. 7A-7C provide amino acid sequences of *Francisella tularensis* Cpf1 (FIG. 7A; SEQ ID NO: 1225), Acidaminococcus sp. BV3L6 Cpf1 (FIG. 7B; SEQ ID NO:1226), and a variant Cpf1 (FIG. 7C; SEQ ID NO:1227).

FIG. 8A-8D provide amino acid sequences DNA polymerases PolI1M (FIG. 8A; SEQ ID NO: 1228), PolI2M (FIG. 8B; SEQ ID NO:1229), PolI3M (FIG. 8C; SEQ ID NO:1230), and PolI3M-TBD (FIG. 8D; SEQ ID NO:1231)

FIG. 9 provides an amino acid sequence of Phi29 DNA polymerase (SEQ ID NO:1232).

FIG. 10 provides an amino acid sequence of a T5 DNA polymerase (SEQ ID NO:1233).

FIG. 11A-11B provide amino acid sequences of T7 DNA polymerase (FIG. 11A; SEQ ID NO: 1234) and Sequenase (FIG. 11B; SEQ ID NO:1235).

FIG. 12 provides an amino acid sequence of a *Sulfolobus solfataricus* DNA-binding protein 7d (Sso7d) (SEQ ID NO:1236).

FIG. 13 provides an amino acid sequence of DNA polymerase Iota (SEQ ID NO:1237).

FIGS. 14A-14B provide an amino acid sequence of DNA polymerase η (SEQ ID NO:1238).

FIGS. 15A-15B provide an amino acid sequence of DNA polymerase K (SEQ ID NO:1239).

FIGS. 16A-16D provide an amino acid sequence of DNA polymerase θ (SEQ ID NO:1240).

FIGS. 17A-17B provide an amino acid sequence of DNA polymerase ν (SEQ ID NO:1241).

FIG. 18 provides an amino acid sequence of *E. coli* DNA polymerase IV (SEQ ID NO:1242).

FIG. 19A-19B provide an amino acid sequence of topoisomerase I (SEQ ID NO:1243).

FIG. 20 provides an amino acid sequence of a flap endonuclease (SEQ ID NO:1244).

FIG. 21 provides an amino acid sequence of a T4 DNA ligase (SEQ ID NO:1245).

FIGS. 23A-23H provide an analysis of mutation rates, mutagenesis window lengths, combinatorial mutations, multiplexed targeting, and continuous diversification of genomic loci.

FIG. 33 provides a comparison of *E. coli* diversification methods.

FIG. 34 provides oligonucleotide sequences.

FIG. 35 provides gRNA protospacer sequences.

FIG. 36 provides plasmid sequences (SEQ ID Nos: 1137-1141, respectively).

FIG. 37 provides amino acid sequences of various Cas9 and DNA polymerase polypeptides.

FIG. 39A-39D depict use of a system of the present disclosure to introduce mutations into a target gene in eukaryotic cells.

FIG. 40A-40D depict fluorescence activated cell sorting (FACS) plots showing the analysis of a mutation into a target gene in eukaryotic cells.

DEFINITIONS

Figure 1:
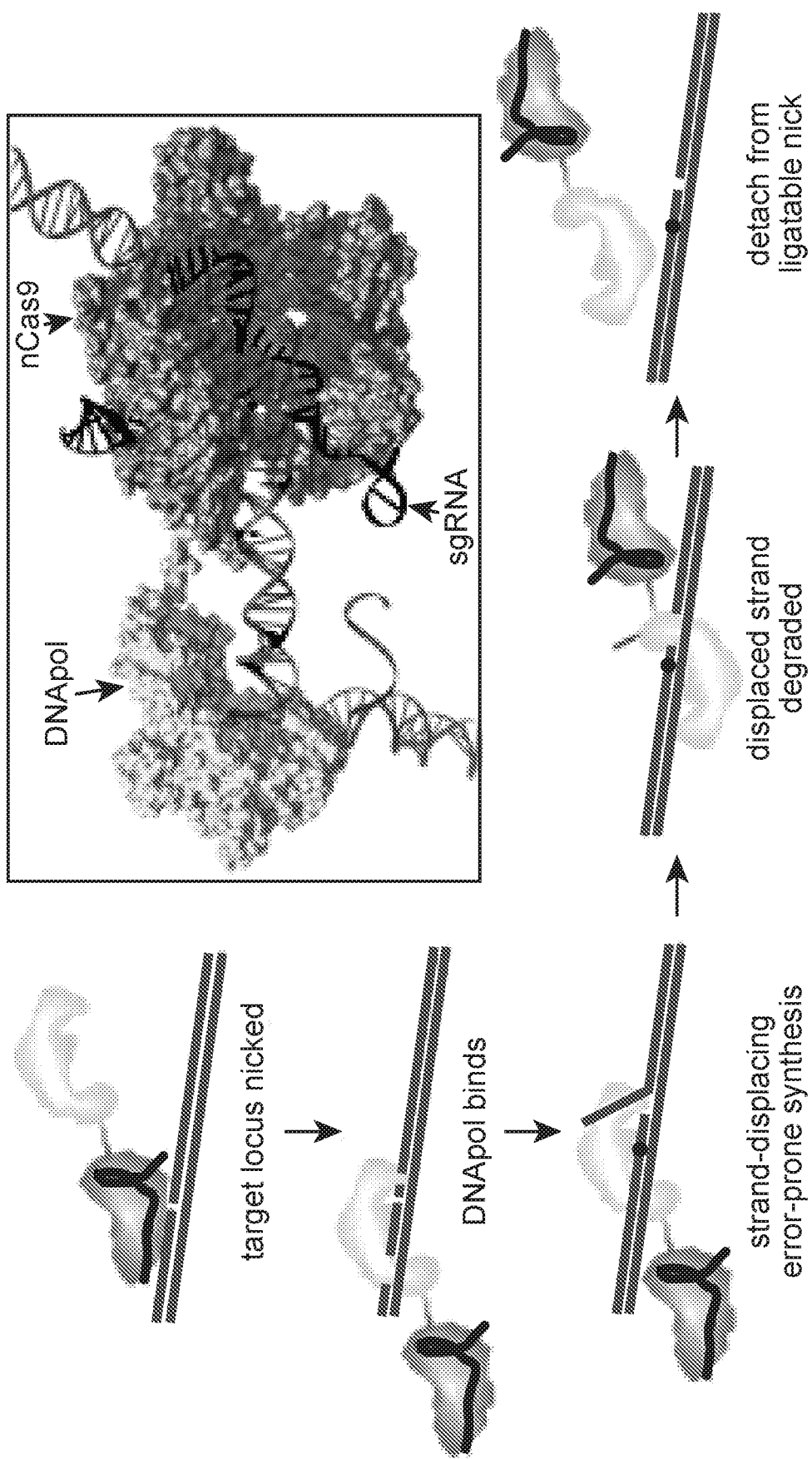
FIG. 1 is a schematic depiction of an example of a fusion polypeptide of the present disclosure.

The terms "polynucleotide" and "nucleic acid," used interchangeably herein, refer to a polymeric form of nucleotides of any length, either ribonucleotides or deoxynucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. The terms "polynucleotide" and "nucleic acid" should be understood to include, as applicable to the embodiment being described, single-stranded (such as sense or antisense) and double-stranded polynucleotides.

The terms "polypeptide," "peptide," and "protein", are used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

The term "naturally-occurring" as used herein as applied to a nucleic acid, a protein, a cell, or an organism, refers to a nucleic acid, cell, protein, or organism that is found in nature.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

"Heterologous," as used herein, refers to a nucleotide or amino acid sequence that is not found in the native nucleic acid or protein, respectively. For example, relative to a Cas9 polypeptide, a heterologous polypeptide comprises an amino acid sequence from a protein other than the Cas9 polypeptide. Thus, for example, a polymerase polypeptide is heterologous to a Cas9 polypeptide.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, nucleotide sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant nucleotide sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "DNA regulatory sequences", below).

Thus, e.g., the term "recombinant" polynucleotide or "recombinant" nucleic acid refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such artificial combination can be carried out to join together nucleic acid segments of desired functions to generate a desired combination of functions.

Similarly, the term "recombinant" polypeptide refers to a polypeptide which is not naturally occurring, e.g., is made by the artificial combination of two otherwise separated segments of amino acid sequence through human intervention. Thus, e.g., a polypeptide that comprises a heterologous amino acid sequence is recombinant.

By "construct" or "vector" is meant a recombinant nucleic acid, generally recombinant DNA, which has been generated for the purpose of the expression and/or propagation of a specific nucleotide sequence(s), or is to be used in the construction of other recombinant nucleotide sequences.

The terms "DNA regulatory sequences," "control elements," and "regulatory elements," used interchangeably herein, refer to transcriptional and translational control sequences, such as promoters, enhancers, polyadenylation signals, terminators, protein degradation signals, and the like, that provide for and/or regulate expression of a coding sequence and/or production of an encoded polypeptide in a host cell.

The term "transformation" is used interchangeably herein with "genetic modification" and refers to a permanent or transient genetic change induced in a cell following introduction of new nucleic acid (e.g., DNA exogenous to the cell) into the cell. Genetic change ("modification") can be accomplished either by incorporation of the new nucleic acid into the genome of the host cell, or by transient or stable maintenance of the new nucleic acid as an episomal element. Where the cell is a eukaryotic cell, a permanent genetic change can be achieved by introduction of new DNA into the genome of the cell. In prokaryotic cells, permanent changes can be introduced into the chromosome or via extrachromosomal elements such as plasmids and expression vectors, which may contain one or more selectable markers to aid in their maintenance in the recombinant host cell. Suitable methods of genetic modification include viral infection, transfection, conjugation, protoplast fusion, electroporation, particle gun technology, calcium phosphate precipitation, direct microinjection, and the like. The choice of method is generally dependent on the type of cell being transformed and the circumstances under which the transformation is taking place (i.e. in vitro, ex vivo, or in vivo). A general discussion of these methods can be found in Ausubel, et al, Short Protocols in Molecular Biology, 3rd ed., Wiley & Sons, 1995.

"Operably linked" refers to a juxtaposition wherein the components so described are in a relationship permitting them to function in their intended manner. For instance, a promoter is operably linked to a coding sequence if the promoter affects its transcription or expression. As used herein, the terms "heterologous promoter" and "heterologous control regions" refer to promoters and other control regions that are not normally associated with a particular nucleic acid in nature. For example, a "transcriptional control region heterologous to a coding region" is a transcriptional control region that is not normally associated with the coding region in nature.

A "host cell," as used herein, denotes an in vivo or in vitro eukaryotic cell, a prokaryotic cell, or a cell from a multicellular organism (e.g., a cell line) cultured as a unicellular entity, which eukaryotic or prokaryotic cells can be, or have been, used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector. For example, a prokaryotic host cell is a genetically modified prokaryotic host cell (e.g., a bacterium), by virtue of introduction into a suitable prokaryotic host cell of a heterologous nucleic acid, e.g., an exogenous nucleic acid that is foreign to (not normally found in nature in) the prokaryotic host cell, or a recombinant nucleic acid that is not normally found in the prokaryotic host cell; and a eukaryotic host cell is a genetically modified eukaryotic host cell, by virtue of introduction into a suitable eukaryotic host cell of a heterologous nucleic acid, e.g., an exogenous nucleic acid that is foreign to the eukaryotic host cell, or a recombinant nucleic acid that is not normally found in the eukaryotic host cell.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence similarity can be determined in a number of different manners. To determine sequence identity, sequences can be aligned using the methods and computer programs, including BLAST, available over the world wide web at ncbi.nlm.nih.gov/BLAST. See, e.g., Altschul et al. (1990), *J. Mol. Biol.* 215:403-10. Another alignment algorithm is FASTA, available in the Genetics Computing Group (GCG) package, from Madison, Wisconsin, USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, California, USA. Of particular interest are alignment programs that permit gaps in the sequence. The Smith-Waterman is one type of algorithm that permits gaps in sequence alignments. See *Meth. Mol. Biol.* 70:173-187 (1997). Also, the GAP program using the Needleman and Wunsch alignment method can be utilized to align sequences. See *J. Mol. Biol.* 48:443-453 (1970).

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a guide RNA" includes a plurality of such guide RNAs and reference to "the RNA-guided endonuclease" includes reference to one or more RNA-guided endonucleases and equivalents thereof known to those skilled in the art, and so forth. It is further noted that the claims may be drafted to exclude any optional element. As such, this statement is intended to serve as antecedent basis for use of such exclusive terminology as "solely,"

"only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides a fusion polypeptide comprising: a) an enzymatically active RNA-guided endonuclease that introduces a single-stranded break (a nick) in a target DNA; and b) an error-prone DNA polymerase. The present disclosure provides a system comprising: a) a fusion polypeptide of the present disclosure; and b) a guide RNA. The present disclosure provides a cell comprising a fusion polypeptide of the present disclosure, or a system of the present disclosure. The present disclosure provides a method of mutagenizing a target polynucleotide.

Fusion Polypeptides

The present disclosure provides a fusion polypeptide comprising: a) an enzymatically active RNA-guided endonuclease that introduces a single-stranded break in a target DNA; and b) an error-prone DNA polymerase. A fusion polypeptide of the present disclosure is also referred to herein as a "mutator."

In some cases, a fusion polypeptide of the present disclosure comprises, in order from N-terminus to C-terminus: a) an enzymatically active RNA-guided endonuclease that introduces a single-stranded break in a target DNA; and b) an error-prone DNA polymerase. In some cases, a fusion polypeptide of the present disclosure comprises, in order from N-terminus to C-terminus: a) an error-prone DNA polymerase; and b) an enzymatically active RNA-guided endonuclease that introduces a single-stranded break in a target DNA.

In some cases, a fusion polypeptide of the present disclosure comprises, in order from N-terminus to C-terminus: a) an enzymatically active RNA-guided endonuclease that introduces a single-stranded break in a target DNA; b) a peptide linker; and c) an error-prone DNA polymerase. In some instances, the fusion polypeptide comprises one or more nuclear localization signals (NLSs). For example, in some cases, the fusion polypeptide comprises a single NLS at the N-terminus of the fusion polypeptide. In some cases, the fusion polypeptide comprises 2, 3, or 4 NLSs at the N-terminus of the fusion polypeptide. In other instances, in some cases, the fusion polypeptide comprises a single NLS at the C-terminus of the fusion polypeptide. In some cases, the fusion polypeptide comprises 2, 3, or 4 NLSs at the C-terminus of the fusion polypeptide.

In some cases, a fusion polypeptide of the present disclosure comprises, in order from N-terminus to C-terminus: a) an error-prone DNA polymerase; b) a peptide linker; and c) an enzymatically active RNA-guided endonuclease that introduces a single-stranded break in a target DNA. In some instances, the fusion polypeptide comprises one or more NLSs. For example, in some cases, the fusion polypeptide comprises a single NLS at the N-terminus of the fusion polypeptide. In some cases, the fusion polypeptide comprises 2, 3, or 4 NLSs at the N-terminus of the fusion polypeptide. In other instances, in some cases, the fusion polypeptide comprises a single NLS at the C-terminus of the fusion polypeptide. In some cases, the fusion polypeptide comprises 2, 3, or 4 NLSs at the C-terminus of the fusion polypeptide.

The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers can be produced by using synthetic, linker-encoding oligonucleotides to couple the proteins, or can be encoded by a nucleic acid sequence encoding the fusion protein. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use.

Examples of linker polypeptides include glycine polymers $(G)_n$, glycine-serine polymers (including, for example, $(GS)_n$, $(GSGGS)_n$, (SEQ ID NO:1154), $(GGSGGS)_n$ (SEQ ID NO:1155), and $(GGGS)_n$ (SEQ ID NO:1156), where n is an integer of at least one); glycine-alanine polymers; and alanine-serine polymers. Exemplary linkers can comprise amino acid sequences including, but not limited to, GGSG (SEQ ID NO:1157), GGSGG (SEQ ID NO:1158), GSGSG (SEQ ID NO:1159), GSGGG (SEQ ID NO:1160), GGGSG (SEQ ID NO:1161), GSSSG (SEQ ID NO: 1162), and the like. Also suitable is a linker having the sequence (GGGGS) n, where n is an integer of from 1 to 10 (e.g., 1, 2, 3, 4, 5, 6, 7, 8, 9, or 10). The ordinarily skilled artisan will recognize that design of a peptide conjugated to any desired element can include linkers that are all or partially flexible, such that the linker can include a flexible linker as well as one or more portions that confer less flexible structure.

A fusion polypeptide of the present disclosure exhibits a high degree of processivity. The processivity of DNA synthesis by a DNA polymerase is defined as the number of nucleotides that a polymerase can incorporate into DNA during a single template-binding event, before dissociating from a DNA template.

In some cases, a fusion polypeptide of the present disclosure, when complexed with a guide RNA, exhibits a target mutation rate of from $10^{-8}$ to $10^{-2}$ mutations per nucleotide per genome replication event. In some cases, a fusion polypeptide of the present disclosure, when complexed with a guide RNA, exhibits a target mutation rate of greater than $10^{-8}$ mutations per nucleotide per genome replication event, e.g., greater than $10^{-8}$, greater than $10^{-7}$, greater than $10^{-6}$, greater than $10^{-5}$, greater than $10^{-4}$, or greater than $10^{-3}$, mutations per nucleotide per genome replication event. In some cases, a fusion polypeptide of the present disclosure, when complexed with a guide RNA, exhibits a target mutation rate of from $10^{-8}$ to $10^{-7}$ mutations per nucleotide per genome replication event. In some cases, a fusion polypeptide of the present disclosure, when complexed with a guide RNA, exhibits a target mutation rate of from $10^{-7}$ to $10^{-6}$ mutations per nucleotide per genome replication event. In some cases, a fusion polypeptide of the present disclosure, when complexed with a guide RNA, exhibits a target mutation rate of from $10^{-7}$ to $10^{-5}$ mutations per nucleotide per genome replication event. In some cases, a fusion polypeptide of the present disclosure, when complexed with a guide RNA, exhibits a target mutation rate of from $10^{-5}$ to $10^{-4}$ mutations per nucleotide per genome replication event. In some cases, a fusion polypeptide of the present disclosure, when complexed with a guide RNA, exhibits a target mutation rate of from $10^{-4}$ to $10^{-3}$ mutations per nucleotide per genome replication event. In some cases, a fusion polypeptide of the present disclosure, when complexed with a guide RNA, exhibits a target mutation rate of from $10^{-3}$ to $10^{-2}$ mutations per nucleotide per genome replication event.

In some cases, a fusion polypeptide of the present disclosure, when complexed with a guide RNA, exhibits a target mutation rate of 1 mutation per nucleotide per genome replication event.

In some cases, a fusion polypeptide of the present disclosure, when complexed with a guide RNA, exhibits a ratio of target mutation rate to global mutation rate of at least 1.5:1, at least 2:1, at least 5:1, at least 10:1, at least 25:1, at least 50:1, at least $10^2$:1, at least $5 \times 10^2$:1, at least $10^3$:1, at least $5 \times 10^3$:1, at least $10^4$:1, or more than $10^4$:1. In some cases, a fusion polypeptide of the present disclosure, when complexed with a guide RNA, exhibits a ratio of target mutation rate to global mutation rate of from about 1.5:1 to $10^4$:1, e.g., from about 1.5:1 to 2:1, from 2:1 to 5:1, from 5:1 to 10:1, from 10:1 to 25:1, from 25:1 to 50:1, from 50:1 to $10^2$:1, from $10^2$:1 to $5 \times 10^2$:1, from $5 \times 10^2$:1 to $10^3$:1, from $10^3$:1 to $5 \times 10^3$:1, from $5 \times 10^3$:1 to $10^4$:1, or more than $10^4$:1.

In some cases, a fusion polypeptide of the present disclosure, when complexed with a guide RNA, exhibits a target mutation rate that is at least 2-fold higher than the target mutation rate exhibited by the error-prone DNA polymerase present in the fusion polypeptide when the error-prone DNA polymerase is not fused to the RNA-guided endonuclease present in the fusion polypeptide. In some cases, a fusion polypeptide of the present disclosure, when complexed with a guide RNA, exhibits a target mutation rate that is at least 2-fold, at least 5-fold, at least 10-fold, at least 50-fold, at least $10^2$-fold, at least $5 \times 10^2$-fold, at least $10^3$-fold, at least $5 \times 10^3$-fold, or at least $10^4$-fold, higher than the target mutation rate exhibited by the error-prone DNA polymerase present in the fusion polypeptide when the error-prone DNA polymerase is not fused to the RNA-guided endonuclease present in the fusion polypeptide. In some cases, a fusion polypeptide of the present disclosure, when complexed with a guide RNA, exhibits a target mutation rate that is more than $10^4$-fold higher than the target mutation rate exhibited by the error-prone DNA polymerase present in the fusion polypeptide when the error-prone DNA polymerase is not fused to the RNA-guided endonuclease present in the fusion polypeptide.

In some cases, a fusion polypeptide of the present disclosure, when complexed with a guide RNA, introduces mutations at a distance of from 1 nucleotide to $10^4$ nucleotides from a nick in a target DNA introduced by the RNA-guided endonuclease. For example, in some cases, a fusion polypeptide of the present disclosure, when complexed with a guide RNA, introduces mutations at a distance of from 1 nucleotide (nt) to 10 nucleotides (nt), from 10 nt to 50 nt, from 50 nt to 100 nt, from 100 nt to 500 nt, from 500 nt to $10^3$ nt, from $10^3$ nt to $5 \times 10^3$ nt, or from $5 \times 10^3$ nt to $10^4$ nt from a nick in a target DNA introduced by the RNA-guided endonuclease. In some cases, a fusion polypeptide of the present disclosure, when complexed with a guide RNA, introduces mutations at a distance of from 1 nt to 10 nt from a nick in a target DNA introduced by the RNA-guided endonuclease. In some cases, a fusion polypeptide of the present disclosure, when complexed with a guide RNA, introduces mutations at a distance of from 1 nt to 25 nt from a nick in a target DNA introduced by the RNA-guided endonuclease. In some cases, a fusion polypeptide of the present disclosure, when complexed with a guide RNA, introduces mutations at a distance of from 10 nt to 25 nt from a nick in a target DNA introduced by the RNA-guided endonuclease. In some cases, a fusion polypeptide of the present disclosure, when complexed with a guide RNA, introduces mutations at a distance of from 1 nt to 50 nt from a nick in a target DNA introduced by the RNA-guided endonuclease. In some cases, a fusion polypeptide of the present disclosure, when complexed with a guide RNA, introduces mutations at a distance of from 10 nt to 50 nt from a nick in a target DNA introduced by the RNA-guided endonuclease. In some cases, a fusion polypeptide of the present disclosure, when complexed with a guide RNA, introduces mutations at a distance of from 25 nt to 50 nt from a nick in a target DNA introduced by the RNA-guided endonuclease. In some cases, a fusion polypeptide of the present disclosure, when complexed with a guide RNA, introduces mutations at a distance of from 1 nt to 100 nt from a nick in a target DNA introduced by the RNA-guided endonuclease. In some cases, a fusion polypeptide of the present disclosure, when complexed with a guide RNA, introduces mutations at a distance of from 10 nt to 100 nt from a nick in a target DNA introduced by the RNA-guided endonuclease. In some cases, a fusion polypeptide of the present disclosure, when complexed with a guide RNA, introduces mutations at a distance of from 50 nt to 100 nt from a nick in a target DNA introduced by the RNA-guided endonuclease.

RNA-Guided Endonucleases

A fusion polypeptide of the present disclosure comprises: a) an enzymatically active RNA-guided endonuclease that introduces a single-stranded break in a target DNA; and b) an error-prone DNA polymerase. An RNA-guided endonuclease is also referred to herein as a "genome-editing nuclease."

Examples of RNA-guided endonucleases are CRISPR/Cas endonucleases (e.g., class 2 CRISPR/Cas endonucleases such as a type II, type V, or type VI CRISPR/Cas endonucleases). A CRISPR/Cas endonuclease is also referred to as a CRISPR/Cas effector polypeptide. A suitable genome editing nuclease is a CRISPR/Cas endonuclease (e.g., a class 2 CRISPR/Cas endonuclease such as a type II, type V, or type VI CRISPR/Cas endonuclease). In some cases, a suitable RNA-guided endonuclease is a class 2 CRISPR/Cas endonuclease. In some cases, a suitable RNA-guided endonuclease is a class 2 type II CRISPR/Cas endonuclease (e.g., a Cas9 protein). In some cases, a genome targeting composition includes a class 2 type V CRISPR/Cas endonuclease (e.g., a Cpf1 protein, a C2c1 protein, or a C2c3 protein). In some cases, a suitable RNA-guided endonuclease is a class 2 type VI CRISPR/Cas endonuclease (e.g., a C2c2 protein; also referred to as a "Cas13a" protein). Also suitable for use is a CasX protein. Also suitable for use is a CasY protein.

In some cases, the genome-editing endonuclease is a Type II CRISPR/Cas endonuclease. In some cases, the genome-editing endonuclease is a Cas9 polypeptide. The Cas9 protein is guided to a target site (e.g., stabilized at a target site) within a target nucleic acid sequence (e.g., a chromosomal sequence or an extrachromosomal sequence, e.g., an episomal sequence, a minicircle sequence, a mitochondrial sequence, a chloroplast sequence, etc.) by virtue of its association with the protein-binding segment of the Cas9 guide RNA. In some cases, a Cas9 polypeptide comprises an amino acid sequence having at least 50%, at least 60%, at least 70%, at least 80%, at least 90%, at least 95%, at least 98%, at least 99%, or more than 99%, amino acid sequence identity to the *Streptococcus pyogenes* Cas9 depicted in FIG. 5A. In some cases, a Cas9 polypeptide comprises the amino acid sequence depicted in one of FIG. 5A-5F.

In some cases, the Cas9 polypeptide used in a composition or method of the present disclosure is a *Staphylococcus aureus* Cas9 (saCas9) polypeptide. In some cases, the saCas9 polypeptide comprises an amino acid sequence having at least 85%, at least 90%, at least 95%, at least 98%, at least 99%, or 100%, amino acid sequence identity to the saCas9 amino acid sequence depicted in FIG. 6.

In some cases, the Cas9 polypeptide used in a composition or method of the present disclosure is a *Campylobacter jejuni* Cas9 (CjCas9) polypeptide. CjCas9 recognizes the 5'-NNNVRYM-3' as the protospacer-adjacent motif (PAM). The amino acid sequence of CjCas9 is set forth in SEQ ID NO: 50. In some cases, a Cas9 polypeptide suitable for use in a composition or method of the present disclosure comprises an amino acid sequence having at least 50%, at least 60%, at least 70%, at least 80%, at least 90%, at least 95%, at least 98%, at least 99%, or more than 99%, amino acid sequence identity to the CjCas9 amino acid sequence set forth in SEQ ID NO:50.

In some cases, a suitable Cas9 polypeptide is a high-fidelity (HF) Cas9 polypeptide. Kleinstiver et al. (2016) *Nature* 529:490. For example, amino acids N497, R661, Q695, and Q926 of the amino acid sequence depicted in FIG. 5A are substituted, e.g., with alanine. For example, an HF Cas9 polypeptide can comprise an amino acid sequence having at least 90%, at least 95%, at least 98%, at least 99%, or 100%, amino acid sequence identity to the amino acid sequence depicted in FIG. 5A, where amino acids N497, R661, Q695, and Q926 are substituted, e.g., with alanine.

In some cases, a suitable Cas9 polypeptide exhibits altered PAM specificity. See, e.g., Kleinstiver et al. (2015) *Nature* 523:481.

In some cases, the genome-editing endonuclease is a type V CRISPR/Cas endonuclease. In some cases a type V CRISPR/Cas endonuclease is a Cpf1 protein. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence depicted in FIG. 7A, FIG. 7B, or FIG. 7C.

In some cases, the genome-editing endonuclease is a CasX or a CasY polypeptide. CasX and CasY polypeptides are described in Burstein et al. (2017) *Nature* 542:237.

RNA-Guided Endonucleases

An RNA-guided endonuclease is also referred to herein as a "genome editing nuclease." Examples of suitable genome editing nucleases are CRISPR/Cas endonucleases (e.g., class 2 CRISPR/Cas endonucleases such as a type II, type V, or type VI CRISPR/Cas endonucleases). A suitable genome editing nuclease is a CRISPR/Cas endonuclease (e.g., a class 2 CRISPR/Cas endonuclease such as a type II, type V, or type VI CRISPR/Cas endonuclease). In some cases, a genome targeting composition includes a class 2 CRISPR/Cas endonuclease. In some cases, a genome targeting composition includes a class 2 type II CRISPR/Cas endonuclease (e.g., a Cas9 protein). In some cases, a genome targeting composition includes a class 2 type V CRISPR/Cas endonuclease (e.g., a Cpf1 protein, a C2c1 protein, or a C2c3 protein). In some cases, a genome targeting composition includes a class 2 type VI CRISPR/Cas endonuclease (e.g., a C2c2 protein; also referred to as a "Cas13a" protein). Also suitable for use is a CasX protein. Also suitable for use is a CasY protein.

In some cases, a genome editing nuclease is a fusion protein that is fused to a heterologous polypeptide (also referred to as a "fusion partner"). In some cases, a genome editing nuclease is fused to an amino acid sequence (a fusion partner) that provides for subcellular localization, i.e., the fusion partner is a subcellular localization sequence (e.g., one or more nuclear localization signals (NLSs) for targeting to the nucleus, two or more NLSs, three or more NLSs, etc.).

In some cases, the genome-editing endonuclease is a Type II CRISPR/Case endonuclease. In some cases, the genome-editing endonuclease is a Cas9 polypeptide. The Cas9 protein is guided to a target site (e.g., stabilized at a target site) within a target nucleic acid sequence (e.g., a chromosomal sequence or an extrachromosomal sequence, e.g., an episomal sequence, a minicircle sequence, a mitochondrial sequence, a chloroplast sequence, etc.) by virtue of its association with the protein-binding segment of the Cas9 guide RNA. In some cases, a Cas9 polypeptide comprises an amino acid sequence having at least 50%, at least 60%, at least 70%, at least 80%, at least 90%, at least 95%, at least 98%, at least 99%, or more than 99%, amino acid sequence identity to the *Streptococcus pyogenes* Cas9 depicted in FIG. 5A. In some cases, the Cas9 polypeptide used in a composition or method of the present disclosure is a *Staphylococcus aureus* Cas9 (saCas9) polypeptide. In some cases, the saCas9 polypeptide comprises an amino acid sequence having at least 85%, at least 90%, at least 95%, at least 98%, at least 99%, or 100%, amino acid sequence identity to the saCas9 amino acid sequence depicted in FIG. 6.

In some cases, a suitable Cas9 polypeptide is a high-fidelity (HF) Cas9 polypeptide. Kleinstiver et al. (2016) *Nature* 529:490. For example, amino acids N497, R661, Q695, and Q926 of the amino acid sequence depicted in FIG. 5A are substituted, e.g., with alanine. For example, an HF Cas9 polypeptide can comprise an amino acid sequence having at least 90%, at least 95%, at least 98%, at least 99%, or 100%, amino acid sequence identity to the amino acid sequence depicted in FIG. 5A, where amino acids N497, R661, Q695, and Q926 are substituted, e.g., with alanine.

In some cases, a suitable Cas9 polypeptide exhibits altered PAM specificity. See, e.g., Kleinstiver et al. (2015) *Nature* 523:481.

In some cases, the genome-editing endonuclease is a type V CRISPR/Cas endonuclease. In some cases, a type V CRISPR/Cas endonuclease is a Cpf1 protein. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence depicted in FIG. 7A. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence depicted in FIG. 7B. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence depicted in FIG. 7C.

A nucleic acid that binds to a class 2 CRISPR/Cas endonuclease (e.g., a Cas9 protein; a type V or type VI CRISPR/Cas protein; a Cpf1 protein; etc.) and targets the complex to a specific location within a target nucleic acid is referred to herein as a "guide RNA" or "CRISPR/Cas guide nucleic acid" or "CRISPR/Cas guide RNA." A guide RNA provides target specificity to the complex (the RNP complex) by including a targeting segment, which includes a guide sequence (also referred to herein as a targeting sequence), which is a nucleotide sequence that is complementary to a sequence of a target nucleic acid.

In some cases, a guide RNA includes two separate nucleic acid molecules: an "activator" and a "targeter" and is referred to herein as a "dual guide RNA", a "double-molecule guide RNA", a "two-molecule guide RNA", or a "dgRNA." In some cases, the guide RNA is one molecule (e.g., for some class 2 CRISPR/Cas proteins, the corresponding guide RNA is a single molecule; and in some cases, an activator and targeter are covalently linked to one another, e.g., via intervening nucleotides), and the guide RNA is referred to as a "single guide RNA", a "single-molecule guide RNA," a "one-molecule guide RNA", or simply "sgRNA."

In some cases, a composition of the present disclosure comprises an RNA-guided endonuclease, or both an RNA-guided endonuclease and a guide RNA. In some cases, e.g., where a target nucleic acid comprises a deleterious mutation in a defective allele (e.g., a deleterious mutation in a retinal cell target nucleic acid), the RNA-guided endonuclease/guide RNA complex, together with a donor nucleic acid comprising a nucleotide sequence that corrects the deleterious mutation (e.g., a donor nucleic acid comprising a nucleotide sequence that encodes a functional copy of the protein encoded by the defective allele), can be used to correct the deleterious mutation, e.g., via homology-directed repair (HDR).

In some cases, a composition of the present disclosure comprises: i) an RNA-guided endonuclease; and ii) one guide RNA. In some cases, the guide RNA is a single-molecule (or "single guide") guide RNA (an "sgRNA"). In some cases, the guide RNA is a dual-molecule (or "dual-guide") guide RNA ("dgRNA").

In some cases, a composition of the present disclosure comprises: i) an RNA-guided endonuclease; and ii) 2 separate sgRNAs, where the 2 separate sgRNAs provide for deletion of a target nucleic acid via non-homologous end joining (NHEJ). In some cases, the guide RNAs are sgRNAs. In some cases, the guide RNAs are dgRNAs.

In some cases, a composition of the present disclosure comprises: i) a Cpf1 polypeptide; and ii) a guide RNA precursor; in these cases, the precursor can be cleaved by the Cpf1 polypeptide to generate 2 or more guide RNAs.

Class 2 CRISPR/Cas Endonucleases

RNA-mediated adaptive immune systems in bacteria and archaea rely on Clustered Regularly Interspaced Short Palindromic Repeat (CRISPR) genomic loci and CRISPR-associated (Cas) proteins that function together to provide protection from invading viruses and plasmids. In class 2 CRISPR systems, the functions of the effector complex (e.g., the cleavage of target DNA) are carried out by a single endonuclease (e.g., see Zetsche et al., Cell. 2015 Oct. 22; 163 (3): 759-71; Makarova et al., Nat Rev Microbiol. 2015 November; 13 (11): 722-36; Shmakov et al., Mol Cell. 2015 Nov. 5; 60 (3): 385-97); and Shmakov et al. (2017) *Nature Reviews Microbiology* 15:169. As such, the term "class 2 CRISPR/Cas protein" is used herein to encompass the endonuclease (the target nucleic acid cleaving protein) from class 2 CRISPR systems. Thus, the term "class 2 CRISPR/Cas endonuclease" as used herein encompasses type II CRISPR/Cas proteins (e.g., Cas9); type V-A CRISPR/Cas proteins (e.g., Cpf1 (also referred to a "Cas12a")); type V-B CRISPR/Cas proteins (e.g., C2c1 (also referred to as "Cas12b")); type V-C CRISPR/Cas proteins (e.g., C2c3 (also referred to as "Cas12c")); type V-U1 CRISPR/Cas proteins (e.g., C2c4); type V-U2 CRISPR/Cas proteins (e.g., C2c8); type V-U5 CRISPR/Cas proteins (e.g., C2c5); type V-U4 CRISPR/Cas proteins (e.g., C2c9); type V-U3 CRISPR/Cas proteins (e.g., C2c10); type VI-A CRISPR/Cas proteins (e.g., C2c2 (also known as "Cas13a")); type VI-B CRISPR/Cas proteins (e.g., Cas13b (also known as C2c4)); and type VI-C CRISPR/Cas proteins (e.g., Cas13c (also known as C2c7)). To date, class 2 CRISPR/Cas proteins encompass type II, type V, and type VI CRISPR/Cas proteins, but the term is also meant to encompass any class 2 CRISPR/Cas protein suitable for binding to a corresponding guide RNA and forming an RNP complex.

Type II CRISPR/Cas Endonucleases (e.g., Cas 9)

In natural Type II CRISPR/Cas systems, Cas9 functions as an RNA-guided endonuclease that uses a dual-guide RNA having a crRNA and trans-activating crRNA (tracrRNA) for target recognition and cleavage by a mechanism involving two nuclease active sites in Cas9 that together generate double-stranded DNA breaks (DSBs), or can individually generate single-stranded DNA breaks (SSBs). The Type II CRISPR endonuclease Cas9 and engineered dual-(dgRNA) or single guide RNA (sgRNA) form a ribonucleoprotein (RNP) complex that can be targeted to a desired DNA sequence. Guided by a dual-RNA complex or a chimeric single-guide RNA, Cas9 generates site-specific DSBs or SSBs within double-stranded DNA (dsDNA) target nucleic acids, which are repaired either by non-homologous end joining (NHEJ) or homology-directed recombination (HDR).

A type II CRISPR/Cas endonuclease is a type of class 2 CRISPR/Cas endonuclease. In some cases, the type II CRISPR/Cas endonuclease is a Cas9 protein. A Cas9 protein forms a complex with a Cas9 guide RNA. The guide RNA provides target specificity to a Cas9-guide RNA complex by having a nucleotide sequence (a guide sequence) that is complementary to a sequence (the target site) of a target nucleic acid (as described elsewhere herein). The Cas9 protein of the complex provides the site-specific activity. In other words, the Cas9 protein is guided to a target site (e.g., stabilized at a target site) within a target nucleic acid sequence (e.g. a chromosomal sequence or an extrachromosomal sequence, e.g., an episomal sequence, a minicircle sequence, a mitochondrial sequence, a chloroplast sequence, etc.) by virtue of its association with the protein-binding segment of the Cas9 guide RNA.

A Cas9 protein can bind and/or modify (e.g., cleave, nick, methylate, demethylate, etc.) a target nucleic acid and/or a polypeptide associated with target nucleic acid (e.g., methylation or acetylation of a histone tail) (e.g., when the Cas9 protein includes a fusion partner with an activity). In some cases, the Cas9 protein is a naturally-occurring protein (e.g., naturally occurs in bacterial and/or archaeal cells). In other cases, the Cas9 protein is not a naturally-occurring polypeptide (e.g., the Cas9 protein is a variant Cas9 protein, a chimeric protein, and the like).

Examples of suitable Cas9 proteins include, but are not limited to, those set forth in SEQ ID NOs: 5-816. Naturally occurring Cas9 proteins bind a Cas9 guide RNA, are thereby directed to a specific sequence within a target nucleic acid (a target site), and cleave the target nucleic acid (e.g., cleave dsDNA to generate a double strand break, cleave ssDNA, cleave ssRNA, etc.). A chimeric Cas9 protein is a fusion protein comprising a Cas9 polypeptide that is fused to a heterologous protein (referred to as a fusion partner), where the heterologous protein provides an activity (e.g., one that is not provided by the Cas9 protein). The fusion partner can provide an activity, e.g., enzymatic activity (e.g., nuclease activity, activity for DNA and/or RNA methylation, activity for DNA and/or RNA cleavage, activity for histone acetylation, activity for histone methylation, activity for RNA modification, activity for RNA-binding, activity for RNA splicing etc.). In some cases, a portion of the Cas9 protein (e.g., the RuvC domain and/or the HNH domain) exhibits reduced nuclease activity relative to the corresponding portion of a wild type Cas9 protein (e.g., in some cases the Cas9 protein is a nickase). In some cases, the Cas9 protein is enzymatically inactive, or has reduced enzymatic activity relative to a wild-type Cas9 protein (e.g., relative to *Streptococcus pyogenes* Cas9).

In some cases, a fusion protein comprises: a) a catalytically inactive Cas9 protein (or other catalytically inactive CRISPR effector polypeptide); and b) a catalytically active endonuclease. For example, in some cases, the catalytically active endonuclease is a FokI polypeptide. As one non-limiting example, in some cases, a fusion protein comprises: a) a catalytically inactive Cas9 protein (or other catalytically inactive CRISPR effector polypeptide); and b) is a FokI nuclease comprising an amino acid sequence having at least at least 85%, at least 90%, at least 95%, at least 98%, at least 99%, or 100%, amino acid sequence identity to the FokI amino acid sequence provided below; where the FokI nuclease has a length of from about 195 amino acids to about 200 amino acids.

FokI nuclease amino acid sequence:

(SEQ ID NO: 1214)
QLVKSELEEKKSELRHKLKYVPHEYIELIEIARNSTQDRILEMKV

MEFFMKVYGYRGKHLGGSRKPDGAIYTVGSPIDYGVIVDTKAYSG

GYNLPIGQADEMQRYVEENQTRNKHINPNEWWKVYPSSVTEFKFL

FVSGHFKGNYKAQLTRLNHITNCNGAVLSVEELLIGGEMIKAGTL

TLEEVRRKFNNGEINF.

Assays to determine whether given protein interacts with a Cas9 guide RNA can be any convenient binding assay that tests for binding between a protein and a nucleic acid. Suitable binding assays (e.g., gel shift assays) will be known to one of ordinary skill in the art (e.g., assays that include adding a Cas9 guide RNA and a protein to a target nucleic acid).

Assays to determine whether a protein has an activity (e.g., to determine if the protein has nuclease activity that cleaves a target nucleic acid and/or some heterologous activity) can be any convenient assay (e.g., any convenient nucleic acid cleavage assay that tests for nucleic acid cleavage). Suitable assays (e.g., cleavage assays) will be known to one of ordinary skill in the art and can include adding a Cas9 guide RNA and a protein to a target nucleic acid.

Many Cas9 orthologs from a wide variety of species have been identified and in some cases the proteins share only a few identical amino acids. Identified Cas9 orthologs have similar domain architecture with a central HNH endonuclease domain and a split RuvC/RNaseH domain (e.g., RuvCI, RuvCII, and RuvCIII) (e.g., see Table 1). For example, a Cas9 protein can have 3 different regions (sometimes referred to as RuvC-I, RuvC-II, and RucC-III), that are not contiguous with respect to the primary amino acid sequence of the Cas9 protein, but fold together to form a RuvC domain once the protein is produced and folds. Thus, Cas9 proteins can be said to share at least 4 key motifs with a conserved architecture. Motifs 1, 2, and 4 are RuvC like motifs while motif 3 is an HNH-motif. The motifs set forth in Table 1 may not represent the entire RuvC-like and/or HNH domains as accepted in the art, but Table 1 does present motifs that can be used to help determine whether a given protein is a Cas9 protein.

TABLE 1

Table 1 lists 4 motifs that are present in Cas9 sequences from various species. The amino acids listed in Table 1 are from the Cas9 from *S. pyogenes* (SEQ ID NO: 5).

| Motif # | Motif | Amino acids (residue #s) | Highly conserved |
|---|---|---|---|
| 1 | RuvC-like I | IGLDIGTNSVG WAVI (7-21) (SEQ ID NO: 1) | D10, G12, G17 |
| 2 | RuvC-like II | IVIEMARE (759-766) (SEQ ID NO: 2) | E762 |
| 3 | HNH-motif | DVDHIVPQS FLKDDSIDN KVLTRSDKN (837-863) (SEQ ID NO: 3) | H840, N854, N863 |
| 4 | RuvC-like III | HHAHDAYL (982-989) (SEQ ID NO: 4) | H982, H983, A984, D986, A987 |

In some cases, a suitable Cas9 protein comprises an amino acid sequence having 4 motifs, each of motifs 1-4 having 60% or more, 70% or more, 75% or more, 80% or more, 85% or more, 90% or more, 95% or more, 99% or more or 100% amino acid sequence identity to motifs 1-4 as set forth in SEQ ID NOs: 1-4, respectively (e.g., see Table 1), or to the corresponding portions in any of the amino acid sequences set forth in SEQ ID NOs: 5-816.

In other words, in some cases, a suitable Cas9 polypeptide comprises an amino acid sequence having 4 motifs, each of motifs 1-4 having 60% or more, 70% or more, 75% or more, 80% or more, 85% or more, 90% or more, 95% or more, 99% or more or 100% amino acid sequence identity to motifs 1-4 of the Cas9 amino acid sequence set forth in SEQ ID NO: 5 (e.g., the sequences set forth in SEQ ID NOs: 1-4, e.g., see Table 1), or to the corresponding portions in any of the amino acid sequences set forth in SEQ ID NOs: 6-816.

In some cases, a suitable Cas9 protein comprises an amino acid sequence having 4 motifs, each of motifs 1-4 having 60% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 70% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 75% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 80% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 85% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 90% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 95% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 99% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 100% amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. Any Cas9 protein as defined above can be used as a Cas9 polypeptide, as part of a chimeric Cas9 polypeptide (e.g., a Cas9 fusion protein), any of which can be used in an RNP of the present disclosure.

In some cases, a suitable Cas9 protein comprises an amino acid sequence having 60% or more, 70% or more, 75% or more, 80% or more, 85% or more, 90% or more, 95% or more, 99% or more or 100% amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816.

In some cases, a suitable Cas9 protein comprises an amino acid sequence having 60% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 70% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 75% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 80% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 85% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 90% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 95% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 99% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 100% amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. Any Cas9 protein as defined above can be used as a Cas9 polypeptide, as part of a chimeric Cas9 polypeptide (e.g., a Cas9 fusion protein), any of which can be used in an RNP of the present disclosure.

In some cases, a suitable Cas9 protein comprises an amino acid sequence having 60% or more, 70% or more, 75% or more, 80% or more, 85% or more, 90% or more, 95% or more, 99% or more or 100% amino acid sequence identity to the Cas9 amino acid sequence set forth in SEQ ID NO: 5, or to any of the amino acid sequences set forth as SEQ ID NOs: 6-816.

In some cases, a suitable Cas9 protein comprises an amino acid sequence having 60% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 70% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 75% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 80% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 85% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 90% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 95% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 99% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 100% amino acid sequence identity to the Cas9 amino acid sequence set forth in SEQ ID NO: 5, or to any of the amino acid sequences set forth as SEQ ID NOs: 6-816. Any Cas9 protein as defined above can be used as a Cas9 polypeptide, as part of a chimeric Cas9 polypeptide (e.g., a Cas9 fusion protein), any of which can be used in an RNP of the present disclosure.

In some cases, a Cas9 protein comprises 4 motifs (as listed in Table 1), at least one with (or each with) amino acid sequences having 75% or more, 80% or more, 85% or more, 90% or more, 95% or more, 99% or more or 100% amino acid sequence identity to each of the 4 motifs listed in Table 1 (SEQ ID NOs: 1-4), or to the corresponding portions in any of the amino acid sequences set forth as SEQ ID NOs: 6-816.

Examples of various Cas9 proteins (and Cas9 domain structure) and Cas9 guide RNAs (as well as information regarding requirements related to protospacer adjacent motif (PAM) sequences present in targeted nucleic acids) can be found in the art, for example, see Jinek et al., Science. 2012 Aug. 17; 337 (6096): 816-21; Chylinski et al., RNA Biol. 2013 May; 10 (5): 726-37; Ma et al., Biomed Res Int. 2013; 2013:270805; Hou et al., Proc Natl Acad Sci USA. 2013 Sep. 24; 110 (39): 15644-9; Jinek et al., Elife. 2013; 2: e00471; Pattanayak et al., Nat Biotechnol. 2013 September; 31 (9): 839-43; Qi et al., Cell. 2013 Feb. 28; 152 (5): 1173-83; Wang et al., Cell. 2013 May 9; 153 (4): 910$^{-8}$; Auer et al., Genome Res. 2013 Oct. 31; Chen et al., Nucleic Acids Res. 2013 Nov. 1; 41 (20): e19; Cheng et al., Cell Res. 2013 October; 23 (10): 1163-71; Cho et al., Genetics. 2013 November; 195 (3): 1177-80; DiCarlo et al., Nucleic Acids Res. 2013 April; 41 (7): 4336-43; Dickinson et al., Nat Methods. 2013 October; 10 (10): 1028-34; Ebina et al., Sci Rep. 2013; 3:2510; Fujii et al., Nucleic Acids Res. 2013 Nov. 1; 41 (20): e187; Hu et al., Cell Res. 2013 November; 23 (11): 1322-5; Jiang et al., Nucleic Acids Res. 2013 Nov. 1; 41 (20): e188; Larson et al., Nat Protoc. 2013 November; 8 (11): 2180-96; Mali et al., Nat Methods. 2013 October; 10 (10): 957-63; Nakayama et al., Genesis. 2013 December; 51 (12): 835-43; Ran et al., Nat Protoc. 2013 November; 8 (11): 2281-308; Ran et al., Cell. 2013 Sep. 12; 154 (6): 1380-9; Upadhyay et al., G3 (Bethesda). 2013 Dec. 9; 3 (12): 2233-8; Walsh et al., Proc Natl Acad Sci USA. 2013 Sep. 24; 110 (39): 15514-5; Xie et al., Mol Plant. 2013 Oct. 9; Yang et al., Cell. 2013 Sep. 12; 154 (6): 1370-9; Briner et al., Mol Cell. 2014 Oct. 23; 56 (2): 333-9; Shmakov et al., *Nat Rev Microbiol.* 2017 March; 15 (3): 169-182; and U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; each of which is hereby incorporated by reference in its entirety.

Variant Cas9 Proteins—Nickases and dCas9

In some cases, a Cas9 protein is a variant Cas9 protein. A variant Cas9 protein has an amino acid sequence that is different by at least one amino acid (e.g., has a deletion, insertion, substitution, fusion) when compared to the amino acid sequence of a corresponding wild type Cas9 protein. In some instances, the variant Cas9 protein has an amino acid change (e.g., deletion, insertion, or substitution) that reduces the nuclease activity of the Cas9 protein. For example, in some instances, the variant Cas9 protein has 50% or less, 40% or less, 30% or less, 20% or less, 10% or less, 5% or less, or 1% or less of the nuclease activity of the corresponding wild-type Cas9 protein. In some cases, the variant Cas9 protein has no substantial nuclease activity. When a Cas9 protein is a variant Cas9 protein that has no substantial nuclease activity, it can be referred to as a nuclease defective Cas9 protein or "dCas9" for "dead" Cas9. A protein (e.g., a class 2 CRISPR/Cas protein, e.g., a Cas9 protein) that cleaves one strand but not the other of a double stranded target nucleic acid is referred to herein as a "nickase" (e.g., a "nickase Cas9").

In some cases, a variant Cas9 protein can cleave the complementary strand (sometimes referred to in the art as the target strand) of a target nucleic acid but has reduced ability to cleave the non-complementary strand (sometimes referred to in the art as the non-target strand) of a target nucleic acid. For example, the variant Cas9 protein can have a mutation (amino acid substitution) that reduces the function of the RuvC domain. Thus, the Cas9 protein can be a nickase that cleaves the complementary strand, but does not cleave the non-complementary strand. As a non-limiting example, in some embodiments, a variant Cas9 protein has a mutation at an amino acid position corresponding to residue D10 (e.g., D10A, aspartate to alanine) of SEQ ID NO: 5 (or the corresponding position of any of the proteins set forth in SEQ ID NOs: 6-261 and 264-816) and can therefore cleave the complementary strand of a double stranded target nucleic acid but has reduced ability to cleave the non-complementary strand of a double stranded target nucleic acid (thus resulting in a single strand break (SSB) instead of a double strand break (DSB) when the variant Cas9 protein cleaves a double stranded target nucleic acid) (see, for example, Jinek et al., *Science.* 2012 Aug. 17; 337 (6096): 816-21). See, e.g., SEQ ID NO: 262.

In some cases, a variant Cas9 protein can cleave the non-complementary strand of a target nucleic acid but has reduced ability to cleave the complementary strand of the target nucleic acid. For example, the variant Cas9 protein can have a mutation (amino acid substitution) that reduces the function of the HNH domain. Thus, the Cas9 protein can be a nickase that cleaves the non-complementary strand, but does not cleave the complementary strand. As a non-limiting example, in some embodiments, the variant Cas9 protein has a mutation at an amino acid position corresponding to residue H840 (e.g., an H840A mutation, histidine to alanine) of SEQ ID NO: 5 (or the corresponding position of any of the proteins set forth as SEQ ID NOs: 6-261 and 264-816) and can therefore cleave the non-complementary strand of the target nucleic acid but has reduced ability to cleave (e.g., does not cleave) the complementary strand of the target nucleic acid. Such a Cas9 protein has a reduced ability to cleave a target nucleic acid (e.g., a single stranded target nucleic acid) but retains the ability to bind a target nucleic acid (e.g., a single stranded target nucleic acid). See, e.g., SEQ ID NO: 263.

In some cases, a variant Cas9 protein has a reduced ability to cleave both the complementary and the non-complementary strands of a double stranded target nucleic acid. As a non-limiting example, in some cases, the variant Cas9 protein harbors mutations at amino acid positions corresponding to residues D10 and H840 (e.g., D10A and H840A) of SEQ ID NO: 5 (or the corresponding residues of any of the proteins set forth as SEQ ID NOs: 6-261 and 264-816) such that the polypeptide has a reduced ability to cleave (e.g., does not cleave) both the complementary and the non-complementary strands of a target nucleic acid. Such a Cas9 protein has a reduced ability to cleave a target nucleic acid (e.g., a single stranded or double stranded target nucleic acid) but retains the ability to bind a target nucleic acid. A Cas9 protein that cannot cleave target nucleic acid (e.g., due to one or more mutations, e.g., in the catalytic domains of the RuvC and HNH domains) is referred to as a "dead" Cas9 or simply "dCas9." See, e.g., SEQ ID NO: 264.

Other residues can be mutated to achieve the above effects (i.e. inactivate one or the other nuclease portions). As non-limiting examples, residues D10, G12, G17, E762, H840, N854, N863, H982, H983, A984, D986, and/or A987 of SEQ ID NO: 5 (or the corresponding mutations of any of the proteins set forth as SEQ ID NOs: 6-816) can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or A987 mutation of SEQ ID NO: 5 or the corresponding mutations of any of the proteins set forth as SEQ ID NOs: 6-816, e.g., D10A, G12A, G17A, E762A, H840A, N854A, N863A, H982A, H983A, A984A, and/or D986A), the variant Cas9 protein can still bind to target nucleic acid in a site-specific manner (because it is still guided to a target nucleic acid sequence by a Cas9 guide RNA) as long as it retains the ability to interact with the Cas9 guide RNA.

In addition to the above, a variant Cas9 protein can have the same parameters for sequence identity as described above for Cas9 proteins. Thus, in some cases, a suitable variant Cas9 protein comprises an amino acid sequence having 4 motifs, each of motifs 1-4 having 60% or more, 70% or more, 75% or more, 80% or more, 85% or more, 90% or more, 95% or more, 99% or more or 100% amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816.

In some cases, a suitable variant Cas9 protein comprises an amino acid sequence having 4 motifs, each of motifs 1-4 having 60% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 70% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 75% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 80% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 85% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 90% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 95% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 99% or more amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816. In some cases, a suitable variant Cas9 protein comprises an amino acid sequence having 4 motifs, each of motifs 1-4 having 100% amino acid sequence identity to motifs 1-4 of the Cas9 amino acid sequence set forth as SEQ ID NO: 5 (the motifs are in Table 1, above, and are set forth as SEQ ID NOs: 1-4, respectively), or to the corresponding portions in any of the amino acid sequences set forth in SEQ ID NOs: 6-816.

In some cases, a suitable variant Cas9 protein comprises an amino acid sequence having 60% or more, 70% or more, 75% or more, 80% or more, 85% or more, 90% or more, 95% or more, 99% or more, or 100% amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816.

In some cases, a suitable variant Cas9 protein comprises an amino acid sequence having 60% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 70% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 75% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 80% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 85% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 90% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 95% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 99% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable variant Cas9 protein comprises an amino acid sequence having 100% amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816.

In some cases, a suitable variant Cas9 protein comprises an amino acid sequence having 60% or more, 70% or more, 75% or more, 80% or more, 85% or more, 90% or more, 95% or more, 99% or more, or 100% amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 60% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 70% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 75% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 80% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 85% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 90% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 95% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 99% or more amino acid sequence identity to the Cas9 amino acid sequence set forth in SEQ ID NO: 5, or to any of the amino acid sequences set forth as SEQ ID NOs: 6-816. In some cases, a suitable variant Cas9 protein comprises an amino acid sequence having 100% amino acid sequence identity to the Cas9 amino acid sequence set forth in SEQ ID NO: 5, or to any of the amino acid sequences set forth as SEQ ID NOs: 6-816.

Type V and Type VI CRISPR/Cas Endonucleases

In some cases, a genome targeting composition of the present disclosure includes a type V or type VI CRISPR/Cas endonuclease (i.e., the genome editing endonuclease is a type V or type VI CRISPR/Cas endonuclease) (e.g., Cpf1, C2c1, C2c2, C2c3). Type V and type VI CRISPR/Cas endonucleases are a type of class 2 CRISPR/Cas endonuclease. Examples of type V CRISPR/Cas endonucleases include but are not limited to: Cpf1, C2c1, and C2c3. An example of a type VI CRISPR/Cas endonuclease is C2c2. In some cases, a subject genome targeting composition includes a type V CRISPR/Cas endonuclease (e.g., Cpf1, C2c1, C2c3). In some cases, a Type V CRISPR/Cas endonuclease is a Cpf1 protein. In some cases, a subject genome targeting composition includes a type VI CRISPR/Cas endonuclease (e.g., Cas13a).

Like type II CRISPR/Cas endonucleases, type V and VI CRISPR/Cas endonucleases form a complex with a corresponding guide RNA. The guide RNA provides target specificity to an endonuclease-guide RNA RNP complex by having a nucleotide sequence (a guide sequence) that is complementary to a sequence (the target site) of a target nucleic acid (as described elsewhere herein). The endonuclease of the complex provides the site-specific activity. In other words, the endonuclease is guided to a target site (e.g., stabilized at a target site) within a target nucleic acid sequence (e.g. a chromosomal sequence or an extrachromosomal sequence, e.g., an episomal sequence, a minicircle sequence, a mitochondrial sequence, a chloroplast sequence, etc.) by virtue of its association with the protein-binding segment of the guide RNA.

Examples and guidance related to type V and type VI CRISPR/Cas proteins (e.g., Cpf1, C2c1, C2c2, and C2c3 guide RNAs) can be found in the art, for example, see Zetsche et al., Cell. 2015 Oct. 22; 163 (3): 759-71; Makarova et al., Nat Rev Microbiol. 2015 November; 13 (11): 722-36; Shmakov et al., Mol Cell. 2015 Nov. 5; 60 (3): 385-97; and Shmakov et al. (2017) *Nature Reviews Microbiology* 15:169.

In some cases, the Type V or type VI CRISPR/Cas endonuclease (e.g., Cpf1, C2c1, C2c2, C2c3) is enzymatically active, e.g., the Type V or type VI CRISPR/Cas polypeptide, when bound to a guide RNA, cleaves a target nucleic acid. In some cases, the Type V or type VI CRISPR/Cas endonuclease (e.g., Cpf1, C2c1, C2c2, C2c3) exhibits reduced enzymatic activity relative to a corresponding wild-type a Type V or type VI CRISPR/Cas endonuclease (e.g., Cpf1, C2c1, C2c2, C2c3), and retains DNA binding activity.

In some cases a type V CRISPR/Cas endonuclease is a Cpf1 protein. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 818-822. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the Cpf1 amino acid sequence set forth in any of SEQ ID NOs: 818-822.

In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the Cpf1 amino acid sequence set forth in any of SEQ ID NOs: 818-822. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the Cpf1 amino acid sequence set forth in any of SEQ ID NOs: 818-822. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the Cpf1 amino acid sequence set forth in any of SEQ ID NOs: 818-822. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the Cpf1 amino acid sequence set forth in any of SEQ ID NOs: 818-822.

In some cases, the Cpf1 protein exhibits reduced enzymatic activity relative to a wild-type Cpf1 protein (e.g., relative to a Cpf1 protein comprising the amino acid sequence set forth in any of SEQ ID NOs: 818-822), and retains DNA binding activity. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 818-822; and comprises an amino acid substitution (e.g., a D→A substitution) at an amino acid residue corresponding to amino acid 917 of the Cpf1 amino acid sequence set forth in SEQ ID NO: 818. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 818-822; and comprises an amino acid substitution (e.g., an E→A substitution) at an amino acid residue corresponding to amino acid 1006 of the Cpf1 amino acid sequence set forth in SEQ ID NO: 818. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 818-822; and comprises an amino acid substitution (e.g., a D→A substitution) at an amino acid residue corresponding to amino acid 1255 of the Cpf1 amino acid sequence set forth in SEQ ID NO: 818.

In some cases, a suitable Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 818-822.

In some cases a type V CRISPR/Cas endonuclease is a C2c1 protein (examples include those set forth as SEQ ID NOs: 823-830). In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c1 amino acid sequence set forth in any of SEQ ID NOs: 823-830. In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the C2c1 amino acid sequence set forth in any of SEQ ID NOs: 823-830.

In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the C2c1 amino acid sequences set forth in any of SEQ ID NOs: 823-830). In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the C2c1 amino acid sequence set forth in any of SEQ ID NOs: 823-830. In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the C2c1 amino acid sequence set forth in any of SEQ ID NOs: 823-830. In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the C2c1 amino acid sequence set forth in any of SEQ ID NOs: 823-830.

In some cases, the C2c1 protein exhibits reduced enzymatic activity relative to a wild-type C2c1 protein (e.g., relative to a C2c1 protein comprising the amino acid sequence set forth in any of SEQ ID NOs: 823-830), and retains DNA binding activity. In some cases, a suitable C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c1 amino acid sequence set forth in any of SEQ ID NOs: 823-830.

In some cases a type V CRISPR/Cas endonuclease is a C2c3 protein (examples include those set forth as SEQ ID NOs: 831-834). In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c3 amino acid sequence set forth in any of SEQ ID NOs: 831-834. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the C2c3 amino acid sequence set forth in any of SEQ ID NOs: 831-834.

In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the C2c3 amino acid sequence set forth in any of SEQ ID NOs: 831-834. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the C2c3 amino acid sequence set forth in any of SEQ ID NOs: 831-834. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the C2c3 amino acid sequence set forth in any of SEQ ID NOs: 831-834. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the C2c3 amino acid sequence set forth in any of SEQ ID NOs: 831-834.

In some cases, the C2c3 protein exhibits reduced enzymatic activity relative to a wild-type C2c3 protein (e.g., relative to a C2c3 protein comprising the amino acid sequence set forth in any of SEQ ID NOs: 831-834), and retains DNA binding activity. In some cases, a suitable C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c3 amino acid sequence set forth in any of SEQ ID NOs: 831-834.

In some cases a type VI CRISPR/Cas endonuclease is a C2c2 protein (examples include those set forth as SEQ ID NOs: 835-846). In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c2 amino acid sequence set forth in any of SEQ ID NOs: 835-846. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the C2c2 amino acid sequence set forth in any of SEQ ID NOs: 835-846.

In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the C2c2 amino acid sequence set forth in any of SEQ ID NOs: 835-846. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the C2c2 amino acid sequence set forth in any of SEQ ID NOs: 835-846. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the C2c2 amino acid sequence set forth in any of SEQ ID NOs: 835-846. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the C2c2 amino acid sequence set forth in any of SEQ ID NOs: 835-846.

In some cases, the C2c2 protein exhibits reduced enzymatic activity relative to a wild-type C2c2 protein (e.g., relative to a C2c2 protein comprising the amino acid sequence set forth in any of SEQ ID NOs: 835-846), and retains DNA binding activity. In some cases, a suitable C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c2 amino acid sequence set forth in any of SEQ ID NOs: 835-846.

Examples and guidance related to type V or type VI CRISPR/Cas endonucleases (including domain structure) and guide RNAs (as well as information regarding requirements related to protospacer adjacent motif (PAM) sequences present in targeted nucleic acids) can be found in the art, for example, see Zetsche et al., *Cell.* 2015 Oct. 22; 163 (3): 759-71; Makarova et al., Nat Rev Microbiol. 2015 November; 13 (11): 722-36; Shmakov et al., Mol Cell. 2015 Nov. 5; 60 (3): 385-97; and Shmakov et al., Nat Rev Microbiol. 2017 March; 15 (3): 169-182; and U.S. patents and patent applications: 9,580,701; 20170073695, 20170058272, 20160362668, 20160362667, 20160298078, 20160289637, 20160215300, 20160208243, and 20160208241, each of which is hereby incorporated by reference in its entirety.

CasX and Cas Y Proteins

Suitable RNA-guided endonucleases include CasX and CasY proteins. See, e.g., Burstein et al. (2017) *Nature* 542:237.

Cas9 Guide RNA

A nucleic acid molecule that binds to a Cas9 protein and targets the complex to a specific location within a target nucleic acid is referred to herein as a "Cas9 guide RNA."

A Cas9 guide RNA (can be said to include two segments, a first segment (referred to herein as a "targeting segment"); and a second segment (referred to herein as a "protein-binding segment"). By "segment" it is meant a segment/section/region of a molecule, e.g., a contiguous stretch of nucleotides in a nucleic acid molecule. A segment can also mean a region/section of a complex such that a segment may comprise regions of more than one molecule.

The first segment (targeting segment) of a Cas9 guide RNA includes a nucleotide sequence (a guide sequence) that is complementary to (and therefore hybridizes with) a specific sequence (a target site) within a target nucleic acid (e.g., a target ssRNA, a target ssDNA, the complementary strand of a double stranded target DNA, etc.). The protein-binding segment (or "protein-binding sequence") interacts with (binds to) a Cas9 polypeptide. The protein-binding segment of a subject Cas9 guide RNA includes two complementary stretches of nucleotides that hybridize to one another to form a double stranded RNA duplex (dsRNA duplex). Site-specific binding and/or cleavage of a target nucleic acid (e.g., genomic DNA) can occur at locations (e.g., target sequence of a target locus) determined by base-pairing complementarity between the Cas9 guide RNA (the guide sequence of the Cas9 guide RNA) and the target nucleic acid.

A Cas9 guide RNA and a Cas9 protein form a complex (e.g., bind via non-covalent interactions). The Cas9 guide RNA provides target specificity to the complex by including a targeting segment, which includes a guide sequence (a nucleotide sequence that is complementary to a sequence of a target nucleic acid). The Cas9 protein of the complex provides the site-specific activity (e.g., cleavage activity or an activity provided by the Cas9 protein when the Cas9 protein is a Cas9 fusion polypeptide, i.e., has a fusion partner). In other words, the Cas9 protein is guided to a target nucleic acid sequence (e.g. a target sequence in a chromosomal nucleic acid, e.g., a chromosome; a target sequence in an extrachromosomal nucleic acid, e.g. an episomal nucleic acid, a minicircle, an ssRNA, an ssDNA, etc.; a target sequence in a mitochondrial nucleic acid; a target sequence in a chloroplast nucleic acid; a target sequence in a plasmid; a target sequence in a viral nucleic acid; etc.) by virtue of its association with the Cas9 guide RNA.

The "guide sequence" also referred to as the "targeting sequence" of a Cas9 guide RNA can be modified so that the Cas9 guide RNA can target a Cas9 protein to any desired sequence of any desired target nucleic acid, with the exception that the protospacer adjacent motif (PAM) sequence can be taken into account. Thus, for example, a Cas9 guide RNA can have a targeting segment with a sequence (a guide sequence) that has complementarity with (e.g., can hybridize to) a sequence in a nucleic acid in a eukaryotic cell, e.g., a viral nucleic acid, a eukaryotic nucleic acid (e.g., a eukaryotic chromosome, chromosomal sequence, a eukaryotic RNA, etc.), and the like.

In some embodiments, a Cas9 guide RNA includes two separate nucleic acid molecules: an "activator" and a "targeter" and is referred to herein as a "dual Cas9 guide RNA", a "double-molecule Cas9 guide RNA", or a "two-molecule Cas9 guide RNA" a "dual guide RNA", or a "dgRNA." In some embodiments, the activator and targeter are covalently linked to one another (e.g., via intervening nucleotides) and the guide RNA is referred to as a "single guide RNA", a "Cas9 single guide RNA", a "single-molecule Cas9 guide RNA," or a "one-molecule Cas9 guide RNA", or simply "sgRNA."

A Cas9 guide RNA comprises a crRNA-like ("CRISPR RNA"/"targeter"/"crRNA"/"crRNA repeat") molecule and a corresponding tracrRNA-like ("trans-acting CRISPR RNA"/"activator"/"tracrRNA") molecule. A crRNA-like molecule (targeter) comprises both the targeting segment (single stranded) of the Cas9 guide RNA and a stretch ("duplex-forming segment") of nucleotides that forms one half of the dsRNA duplex of the protein-binding segment of the Cas9 guide RNA. A corresponding tracrRNA-like molecule (activator/tracrRNA) comprises a stretch of nucleotides (duplex-forming segment) that forms the other half of the dsRNA duplex of the protein-binding segment of the guide nucleic acid. In other words, a stretch of nucleotides of a crRNA-like molecule are complementary to and hybridize with a stretch of nucleotides of a tracrRNA-like molecule to form the dsRNA duplex of the protein-binding domain of the Cas9 guide RNA. As such, each targeter molecule can be said to have a corresponding activator molecule (which has a region that hybridizes with the targeter). The targeter molecule additionally provides the targeting segment. Thus, a targeter and an activator molecule (as a corresponding pair) hybridize to form a Cas9 guide RNA. The exact sequence of a given crRNA or tracrRNA molecule is characteristic of the species in which the RNA molecules are found. A subject dual Cas9 guide RNA can include any corresponding activator and targeter pair.

The term "activator" or "activator RNA" is used herein to mean a tracrRNA-like molecule (tracrRNA: "trans-acting CRISPR RNA") of a Cas9 dual guide RNA (and therefore of a Cas9 single guide RNA when the "activator" and the "targeter" are linked together by, e.g., intervening nucleotides). Thus, for example, a Cas9 guide RNA (dgRNA or sgRNA) comprises an activator sequence (e.g., a tracrRNA sequence). A tracr molecule (a tracrRNA) is a naturally existing molecule that hybridizes with a CRISPR RNA molecule (a crRNA) to form a Cas9 dual guide RNA. The term "activator" is used herein to encompass naturally existing tracrRNAs, but also to encompass tracrRNAs with modifications (e.g., truncations, sequence variations, base modifications, backbone modifications, linkage modifications, etc.) where the activator retains at least one function of a tracrRNA (e.g., contributes to the dsRNA duplex to which Cas9 protein binds). In some cases the activator provides one or more stem loops that can interact with Cas9 protein. An activator can be referred to as having a tracr sequence (tracrRNA sequence) and in some cases is a tracrRNA, but the term "activator" is not limited to naturally existing tracrRNAs.

The term "targeter" or "targeter RNA" is used herein to refer to a crRNA-like molecule (crRNA: "CRISPR RNA") of a Cas9 dual guide RNA (and therefore of a Cas9 single guide RNA when the "activator" and the "targeter" are linked together, e.g., by intervening nucleotides). Thus, for example, a Cas9 guide RNA (dgRNA or sgRNA) comprises a targeting segment (which includes nucleotides that hybridize with (are complementary to) a target nucleic acid, and a duplex-forming segment (e.g., a duplex forming segment of a crRNA, which can also be referred to as a crRNA repeat). Because the sequence of a targeting segment (the segment that hybridizes with a target sequence of a target nucleic acid) of a targeter is modified by a user to hybridize with a desired target nucleic acid, the sequence of a targeter will often be a non-naturally occurring sequence. However, the duplex-forming segment of a targeter (described in more detail below), which hybridizes with the duplex-forming segment of an activator, can include a naturally existing sequence (e.g., can include the sequence of a duplex-forming segment of a naturally existing crRNA, which can also be referred to as a crRNA repeat). Thus, the term targeter is used herein to distinguish from naturally occurring crRNAs, despite the fact that part of a targeter (e.g., the duplex-forming segment) often includes a naturally occurring sequence from a crRNA. However, the term "targeter" encompasses naturally occurring crRNAs.

A Cas9 guide RNA can also be said to include 3 parts: (i) a targeting sequence (a nucleotide sequence that hybridizes with a sequence of the target nucleic acid); (ii) an activator sequence (as described above) (in some cases, referred to as a tracr sequence); and (iii) a sequence that hybridizes to at least a portion of the activator sequence to form a double stranded duplex. A targeter has (i) and (iii); while an activator has (ii).

A Cas9 guide RNA (e.g. a dual guide RNA or a single guide RNA) can be comprised of any corresponding activator and targeter pair. In some cases, the duplex forming segments can be swapped between the activator and the targeter. In other words, in some cases, the targeter includes a sequence of nucleotides from a duplex forming segment of a tracrRNA (which sequence would normally be part of an activator) while the activator includes a sequence of nucleotides from a duplex forming segment of a crRNA (which sequence would normally be part of a targeter).

As noted above, a targeter comprises both the targeting segment (single stranded) of the Cas9 guide RNA and a stretch ("duplex-forming segment") of nucleotides that forms one half of the dsRNA duplex of the protein-binding segment of the Cas9 guide RNA. A corresponding tracrRNA-like molecule (activator) comprises a stretch of nucleotides (a duplex-forming segment) that forms the other half of the dsRNA duplex of the protein-binding segment of the Cas9 guide RNA. In other words, a stretch of nucleotides of the targeter is complementary to and hybridizes with a stretch of nucleotides of the activator to form the dsRNA duplex of the protein-binding segment of a Cas9 guide RNA. As such, each targeter can be said to have a corresponding activator (which has a region that hybridizes with the targeter). The targeter molecule additionally provides the targeting segment. Thus, a targeter and an activator (as a corresponding pair) hybridize to form a Cas9 guide RNA. The particular sequence of a given naturally existing crRNA or tracrRNA molecule is characteristic of the species in which the RNA molecules are found. Examples of suitable activator and targeter are well known in the art.

A Cas9 guide RNA (e.g. a dual guide RNA or a single guide RNA) can be comprised of any corresponding activator and targeter pair. Non-limiting examples of nucleotide sequences that can be included in a Cas9 guide RNA (dgRNA or sgRNA) include sequences set forth in SEQ ID NOs: 847-1095, or complements thereof. For example, in some cases, sequences from SEQ ID NOs: 847-977 (which are from tracrRNAs) or complements thereof, can pair with sequences from SEQ ID NOs: 867-1095 (which are from crRNAs), or complements thereof, to form a dsRNA duplex of a protein binding segment.

Targeting Segment of a Cas9 Guide RNA

The first segment of a subject guide nucleic acid includes a guide sequence (i.e., a targeting sequence) (a nucleotide sequence that is complementary to a sequence (a target site) in a target nucleic acid). In other words, the targeting segment of a subject guide nucleic acid can interact with a target nucleic acid (e.g., double stranded DNA (dsDNA)) in a sequence-specific manner via hybridization (i.e., base pairing). As such, the nucleotide sequence of the targeting segment may vary (depending on the target) and can determine the location within the target nucleic acid that the Cas9 guide RNA and the target nucleic acid will interact. The targeting segment of a Cas9 guide RNA can be modified (e.g., by genetic engineering)/designed to hybridize to any desired sequence (target site) within a target nucleic acid (e.g., a eukaryotic target nucleic acid such as genomic DNA).

The targeting segment can have a length of 7 or more nucleotides (nt) (e.g., 8 or more, 9 or more, 10 or more, 12 or more, 15 or more, 20 or more, 25 or more, 30 or more, or 40 or more nucleotides). In some cases, the targeting segment can have a length of from 7 to 100 nucleotides (nt) (e.g., from 7 to 80 nt, from 7 to 60 nt, from 7 to 40 nt, from 7 to 30 nt, from 7 to 25 nt, from 7 to 22 nt, from 7 to 20 nt, from 7 to 18 nt, from 8 to 80 nt, from 8 to 60 nt, from 8 to 40 nt, from 8 to 30 nt, from 8 to 25 nt, from 8 to 22 nt, from 8 to 20 nt, from 8 to 18 nt, from 10 to 100 nt, from 10 to 80 nt, from 10 to 60 nt, from 10 to 40 nt, from 10 to 30 nt, from 10 to 25 nt, from 10 to 22 nt, from 10 to 20 nt, from 10 to 18 nt, from 12 to 100 nt, from 12 to 80 nt, from 12 to 60 nt, from 12 to 40 nt, from 12 to 30 nt, from 12 to 25 nt, from 12 to 22 nt, from 12 to 20 nt, from 12 to 18 nt, from 14 to 100 nt, from 14 to 80 nt, from 14 to 60 nt, from 14 to 40 nt, from 14 to 30 nt, from 14 to 25 nt, from 14 to 22 nt, from 14 to 20 nt, from 14 to 18 nt, from 16 to 100 nt, from 16 to 80 nt, from 16 to 60 nt, from 16 to 40 nt, from 16 to 30 nt, from 16 to 25 nt, from 16 to 22 nt, from 16 to 20 nt, from 16 to 18 nt, from 18 to 100 nt, from 18 to 80 nt, from 18 to 60 nt, from 18 to 40 nt, from 18 to 30 nt, from 18 to 25 nt, from 18 to 22 nt, or from 18 to 20 nt).

The nucleotide sequence (the targeting sequence) of the targeting segment that is complementary to a nucleotide sequence (target site) of the target nucleic acid can have a length of 10 nt or more. For example, the targeting sequence of the targeting segment that is complementary to a target site of the target nucleic acid can have a length of 12 nt or more, 15 nt or more, 18 nt or more, 19 nt or more, or 20 nt or more. In some cases, the nucleotide sequence (the targeting sequence) of the targeting segment that is complementary to a nucleotide sequence (target site) of the target nucleic acid has a length of 12 nt or more. In some cases, the nucleotide sequence (the targeting sequence) of the targeting segment that is complementary to a nucleotide sequence (target site) of the target nucleic acid has a length of 18 nt or more.

For example, the targeting sequence of the targeting segment that is complementary to a target sequence of the target nucleic acid can have a length of from 10 to 100 nucleotides (nt) (e.g., from 10 to 90 nt, from 10 to 75 nt, from 10 to 60 nt, from 10 to 50 nt, from 10 to 35 nt, from 10 to 30 nt, from 10 to 25 nt, from 10 to 22 nt, from 10 to 20 nt, from 12 to 100 nt, from 12 to 90 nt, from 12 to 75 nt, from 12 to 60 nt, from 12 to 50 nt, from 12 to 35 nt, from 12 to 30 nt, from 12 to 25 nt, from 12 to 22 nt, from 12 to 20 nt, from 15 to 100 nt, from 15 to 90 nt, from 15 to 75 nt, from 15 to 60 nt, from 15 to 50 nt, from 15 to 35 nt, from 15 to 30 nt, from 15 to 25 nt, from 15 to 22 nt, from 15 to 20 nt, from 17 to 100 nt, from 17 to 90 nt, from 17 to 75 nt, from 17 to 60 nt, from 17 to 50 nt, from 17 to 35 nt, from 17 to 30 nt, from 17 to 25 nt, from 17 to 22 nt, from 17 to 20 nt, from 18 to 100 nt, from 18 to 90 nt, from 18 to 75 nt, from 18 to 60 nt, from 18 to 50 nt, from 18 to 35 nt, from 18 to 30 nt, from 18 to 25 nt, from 18 to 22 nt, or from 18 to 20 nt). In some cases, the targeting sequence of the targeting segment that is complementary to a target sequence of the target nucleic acid has a length of from 15 nt to 30 nt. In some cases, the targeting sequence of the targeting segment that is complementary to a target sequence of the target nucleic acid has a length of from 15 nt to 25 nt. In some cases, the targeting sequence of the targeting segment that is complementary to a target sequence of the target nucleic acid has a length of from 18 nt to 30 nt. In some cases, the targeting sequence of the targeting segment that is complementary to a target sequence of the target nucleic acid has a length of from 18 nt to 25 nt. In some cases, the targeting sequence of the targeting segment that is complementary to a target sequence of the target nucleic acid has a length of from 18 nt to 22 nt. In some cases, the targeting sequence of the targeting segment that is complementary to a target site of the target nucleic acid is 20 nucleotides in length. In some cases, the targeting sequence of the targeting segment that is complementary to a target site of the target nucleic acid is 19 nucleotides in length.

The percent complementarity between the targeting sequence (guide sequence) of the targeting segment and the target site of the target nucleic acid can be 60% or more (e.g., 65% or more, 70% or more, 75% or more, 80% or more, 85% or more, 90% or more, 95% or more, 97% or more, 98% or more, 99% or more, or 100%). In some cases, the percent complementarity between the targeting sequence of the targeting segment and the target site of the target nucleic acid is 100% over the seven contiguous 5'-most nucleotides of the target site of the target nucleic acid. In some cases, the percent complementarity between the targeting sequence of the targeting segment and the target site of the target nucleic acid is 60% or more over about 20 contiguous nucleotides. In some cases, the percent complementarity between the targeting sequence of the targeting segment and the target site of the target nucleic acid is 100% over the fourteen contiguous 5'-most nucleotides of the target site of the target nucleic acid and as low as 0% or more over the remainder. In such a case, the targeting sequence can be considered to be 14 nucleotides in length. In some cases, the percent complementarity between the targeting sequence of the targeting segment and the target site of the target nucleic acid is 100% over the seven contiguous 5'-most nucleotides of the target site of the target nucleic acid and as low as 0% or more over the remainder. In such a case, the targeting sequence can be considered to be 20 nucleotides in length.

In some cases, the percent complementarity between the targeting sequence of the targeting segment and the target site of the target nucleic acid is 100% over the 7 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 8 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 9 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 10 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 17 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 18 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 60% or more (e.g., e.g., 65% or more, 70% or more, 75% or more, 80% or more, 85% or more, 90% or more, 95% or more, 97% or more, 98% or more, 99% or more, or 100%) over about 20 contiguous nucleotides.

In some cases, the percent complementarity between the targeting sequence of the targeting segment and the target site of the target nucleic acid is 100% over the 7 contiguous 5'-most nucleotides of the target site of the target nucleic acid and as low as 0% or more over the remainder. In such a case, the targeting sequence can be considered to be 7 nucleotides in length. In some cases, the percent complementarity between the targeting sequence of the targeting segment and the target site of the target nucleic acid is 100% over the 8 contiguous 5'-most nucleotides of the target site of the target nucleic acid and as low as 0% or more over the remainder. In such a case, the targeting sequence can be considered to be 8 nucleotides in length. In some cases, the percent complementarity between the targeting sequence of the targeting segment and the target site of the target nucleic acid is 100% over the 9 contiguous 5'-most nucleotides of the target site of the target nucleic acid and as low as 0% or more over the remainder. In such a case, the targeting sequence can be considered to be 9 nucleotides in length. In some cases, the percent complementarity between the targeting sequence of the targeting segment and the target site of the target nucleic acid is 100% over the 10 contiguous 5'-most nucleotides of the target site of the target nucleic acid and as low as 0% or more over the remainder. In such a case, the targeting sequence can be considered to be 10 nucleotides in length. In some cases, the percent complementarity between the targeting sequence of the targeting segment and the target site of the target nucleic acid is 100% over the 11 contiguous 5'-most nucleotides of the target site of the target nucleic acid and as low as 0% or more over the remainder. In such a case, the targeting sequence can be considered to be 11 nucleotides in length. In some cases, the percent complementarity between the targeting sequence of the targeting segment and the target site of the target nucleic acid is 100% over the 12 contiguous 5'-most nucleotides of the target site of the target nucleic acid and as low as 0% or more over the remainder. In such a case, the targeting sequence can be considered to be 12 nucleotides in length. In some cases, the percent complementarity between the targeting sequence of the targeting segment and the target site of the target nucleic acid is 100% over the 13 contiguous 5'-most nucleotides of the target site of the target nucleic acid and as low as 0% or more over the remainder. In such a case, the targeting sequence can be considered to be 13 nucleotides in length. In some cases, the percent complementarity between the targeting sequence of the targeting segment and the target site of the target nucleic acid is 100% over the 14 contiguous 5'-most nucleotides of the target site of the target nucleic acid and as low as 0% or more over the remainder. In such a case, the targeting sequence can be considered to be 14 nucleotides in length. In some cases, the percent complementarity between the targeting sequence of the targeting segment and the target site of the target nucleic acid is 100% over the 17 contiguous 5'-most nucleotides of the target site of the target nucleic acid and as low as 0% or more over the remainder. In such a case, the targeting sequence can be considered to be 17 nucleotides in length. In some cases, the percent complementarity between the targeting sequence of the targeting segment and the target site of the target nucleic acid is 100% over the 18 contiguous 5'-most nucleotides of the target site of the target nucleic acid and as low as 0% or more over the remainder. In such a case, the targeting sequence can be considered to be 18 nucleotides in length.

Examples of various Cas9 proteins and Cas9 guide RNAs (as well as information regarding requirements related to protospacer adjacent motif (PAM) sequences present in targeted nucleic acids) can be found in the art, for example, see Jinek et al., Science. 2012 August 17; 337 (6096): 816-21; Chylinski et al., RNA Biol. 2013 May; 10 (5): 726-37; Ma et al., Biomed Res Int. 2013; 2013:270805; Hou et al., Proc Natl Acad Sci USA. 2013 Sep. 24; 110 (39): 15644-9; Jinek et al., Elife. 2013; 2: e00471; Pattanayak et al., Nat Biotechnol. 2013 September; 31 (9): 839-43; Qi et al., Cell. 2013 Feb. 28; 152 (5): 1173-83; Wang et al., Cell. 2013 May 9; 153 (4): 910$^{-8}$; Auer et al., Genome Res. 2013 Oct. 31; Chen et al., Nucleic Acids Res. 2013 Nov. 1; 41 (20): e19; Cheng et al., Cell Res. 2013 October; 23 (10): 1163-71; Cho et al., Genetics. 2013 November; 195 (3): 1177-80; DiCarlo et al., Nucleic Acids Res. 2013 April; 41 (7): 4336-43; Dickinson et al., Nat Methods. 2013 October; 10 (10): 1028-34; Ebina et al., Sci Rep. 2013; 3:2510; Fujii et al., Nucleic Acids Res. 2013 Nov. 1; 41 (20): e187; Hu et al., Cell Res. 2013 November; 23 (11): 1322-5; Jiang et al., Nucleic Acids Res. 2013 Nov. 1; 41 (20): e188; Larson et al., Nat Protoc. 2013 November; 8 (11): 2180-96; Mali et al., Nat Methods. 2013 October; 10 (10): 957-63; Nakayama et al., Genesis. 2013 December; 51 (12): 835-43; Ran et al., Nat Protoc. 2013 November; 8 (11): 2281-308; Ran et al., Cell. 2013 Sep. 12; 154 (6): 1380-9; Upadhyay et al., G3 (Bethesda). 2013 Dec. 9; 3 (12): 2233-8; Walsh et al., Proc Natl Acad Sci USA. 2013 Sep. 24; 110 (39): 15514-5; Xie et al., Mol Plant. 2013 Oct. 9; Yang et al., Cell. 2013 Sep. 12; 154 (6): 1370-9; Briner et al., Mol Cell. 2014 Oct. 23; 56 (2): 333-9; and U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety.

Guide RNAs Corresponding to Type V and Type VI CRISPR/Cas Endonucleases (e.g., Cpf1 Guide RNA)

A guide RNA that binds to a type V or type VI CRISPR/Cas protein (e.g., Cpf1, C2c1, C2c2, C2c3), and targets the complex to a specific location within a target nucleic acid is referred to herein generally as a "type V or type VI CRISPR/Cas guide RNA". An example of a more specific term is a "Cpf1 guide RNA."

A type V or type VI CRISPR/Cas guide RNA (e.g., cpf1 guide RNA) can have a total length of from 30 nucleotides (nt) to 200 nt, e.g., from 30 nt to 180 nt, from 30 nt to 160 nt, from 30 nt to 150 nt, from 30 nt to 125 nt, from 30 nt to 100 nt, from 30 nt to 90 nt, from 30 nt to 80 nt, from 30 nt to 70 nt, from 30 nt to 60 nt, from 30 nt to 50 nt, from 50 nt to 200 nt, from 50 nt to 180 nt, from 50 nt to 160 nt, from 50 nt to 150 nt, from 50 nt to 125 nt, from 50 nt to 100 nt, from 50 nt to 90 nt, from 50 nt to 80 nt, from 50 nt to 70 nt, from 50 nt to 60 nt, from 70 nt to 200 nt, from 70 nt to 180 nt, from 70 nt to 160 nt, from 70 nt to 150 nt, from 70 nt to 125 nt, from 70 nt to 100 nt, from 70 nt to 90 nt, or from 70 nt to 80 nt). In some cases, a type V or type VI CRISPR/Cas guide RNA (e.g., cpf1 guide RNA) has a total length of at least 30 nt (e.g., at least 40 nt, at least 50 nt, at least 60 nt, at least 70 nt, at least 80 nt, at least 90 nt, at least 100 nt, or at least 120 nt,).

In some cases, a Cpf1 guide RNA has a total length of 35 nt, 36 nt, 37 nt, 38 nt, 39 nt, 40 nt, 41 nt, 42 nt, 43 nt, 44 nt, 45 nt, 46 nt, 47 nt, 48 nt, 49 nt, or 50 nt.

Like a Cas9 guide RNA, a type V or type VI CRISPR/Cas guide RNA (e.g., cpf1 guide RNA) can include a target nucleic acid-binding segment and a duplex-forming region (e.g., in some cases formed from two duplex-forming segments, i.e., two stretches of nucleotides that hybridize to one another to form a duplex).

The target nucleic acid-binding segment of a type V or type VI CRISPR/Cas guide RNA (e.g., cpf1 guide RNA) can have a length of from 15 nt to 30 nt, e.g., 15 nt, 16 nt, 17 nt, 18 nt, 19 nt, 20 nt, 21 nt, 22 nt, 23 nt, 24 nt, 25 nt, 26 nt, 27 nt, 28 nt, 29 nt, or 30 nt. In some cases, the target nucleic acid-binding segment has a length of 23 nt. In some cases, the target nucleic acid-binding segment has a length of 24 nt. In some cases, the target nucleic acid-binding segment has a length of 25 nt.

The guide sequence of a type V or type VI CRISPR/Cas guide RNA (e.g., cpf1 guide RNA) can have a length of from 15 nt to 30 nt (e.g., 15 to 25 nt, 15 to 24 nt, 15 to 23 nt, 15 to 22 nt, 15 to 21 nt, 15 to 20 nt, 15 to 19 nt, 15 to 18 nt, 17 to 30 nt, 17 to 25 nt, 17 to 24 nt, 17 to 23 nt, 17 to 22 nt, 17 to 21 nt, 17 to 20 nt, 17 to 19 nt, 17 to 18 nt, 18 to 30 nt, 18 to 25 nt, 18 to 24 nt, 18 to 23 nt, 18 to 22 nt, 18 to 21 nt, 18 to 20 nt, 18 to 19 nt, 19 to 30 nt, 19 to 25 nt, 19 to 24 nt, 19 to 23 nt, 19 to 22 nt, 19 to 21 nt, 19 to 20 nt, 20 to 30 nt, 20 to 25 nt, 20 to 24 nt, 20 to 23 nt, 20 to 22 nt, 20 to 21 nt, 15 nt, 16 nt, 17 nt, 18 nt, 19 nt, 20 nt, 21 nt, 22 nt, 23 nt, 24 nt, 25 nt, 26 nt, 27 nt, 28 nt, 29 nt, or 30 nt). In some cases, the guide sequence has a length of 17 nt. In some cases, the guide sequence has a length of 18 nt. In some cases, the guide sequence has a length of 19 nt. In some cases, the guide sequence has a length of 20 nt. In some cases, the guide sequence has a length of 21 nt. In some cases, the guide sequence has a length of 22 nt. In some cases, the guide sequence has a length of 23 nt. In some cases, the guide sequence has a length of 24 nt.

The guide sequence of a type V or type VI CRISPR/Cas guide RNA (e.g., cpf1 guide RNA) can have 100% complementarity with a corresponding length of target nucleic acid sequence. The guide sequence can have less than 100% complementarity with a corresponding length of target nucleic acid sequence. For example, the guide sequence of a type V or type VI CRISPR/Cas guide RNA (e.g., cpf1 guide RNA) can have 1, 2, 3, 4, or 5 nucleotides that are not complementary to the target nucleic acid sequence. For example, in some cases, where a guide sequence has a length of 25 nucleotides, and the target nucleic acid sequence has a length of 25 nucleotides, in some cases, the target nucleic acid-binding segment has 100% complementarity to the target nucleic acid sequence. As another example, in some cases, where a guide sequence has a length of 25 nucleotides, and the target nucleic acid sequence has a length of 25 nucleotides, in some cases, the target nucleic acid-binding segment has 1 non-complementary nucleotide and 24 complementary nucleotides with the target nucleic acid sequence. As another example, in some cases, where a guide sequence has a length of 25 nucleotides, and the target nucleic acid sequence has a length of 25 nucleotides, in some cases, the target nucleic acid-binding segment has 2 non-complementary nucleotides and 23 complementary nucleotides with the target nucleic acid sequence.

The duplex-forming segment of a type V or type VI CRISPR/Cas guide RNA (e.g., cpf1 guide RNA) (e.g., of a targeter RNA or an activator RNA) can have a length of from 15 nt to 25 nt (e.g., 15 nt, 16 nt, 17 nt, 18 nt, 19 nt, 20 nt, 21 nt, 22 nt, 23 nt, 24 nt, or 25 nt).

The RNA duplex of a type V or type VI CRISPR/Cas guide RNA (e.g., cpf1 guide RNA) can have a length of from 5 base pairs (bp) to 40 bp (e.g., from 5 to 35 bp, 5 to 30 bp, 5 to 25 bp, 5 to 20 bp, 5 to 15 bp, 5-12 bp, 5-10 bp, 5-8 bp, 6 to 40 bp, 6 to 35 bp, 6 to 30 bp, 6 to 25 bp, 6 to 20 bp, 6 to 15 bp, 6 to 12 bp, 6 to 10 bp, 6 to 8 bp, 7 to 40 bp, 7 to 35 bp, 7 to 30 bp, 7 to 25 bp, 7 to 20 bp, 7 to 15 bp, 7 to 12 bp, 7 to 10 bp, 8 to 40 bp, 8 to 35 bp, 8 to 30 bp, 8 to 25 bp, 8 to 20 bp, 8 to 15 bp, 8 to 12 bp, 8 to 10 bp, 9 to 40 bp, 9 to 35 bp, 9 to 30 bp, 9 to 25 bp, 9 to 20 bp, 9 to 15 bp, 9 to 12 bp, 9 to 10 bp, 10 to 40 bp, 10 to 35 bp, 10 to 30 bp, 10 to 25 bp, 10 to 20 bp, 10 to 15 bp, or 10 to 12 bp).

As an example, a duplex-forming segment of a Cpf1 guide RNA can comprise a nucleotide sequence selected from (5' to 3'): AAUUUCUACUGUUGUAGAU (SEQ ID NO: 1096), AAUUUCUGCUGUUGCAGAU (SEQ ID NO: 1097), AAUUUCCACUGUUGUGGAU (SEQ ID NO: 1098), AAUUCCUACUGUUGUAGGU (SEQ ID NO: 1099), AAUUUCUACUAUUGUAGAU (SEQ ID NO: 1100), AAUUUCUACUGCUGUAGAU (SEQ ID NO: 1101), AAUUUCUACUUUGUAGAU (SEQ ID NO: 1102), and AAUUUCUACUUGUAGAU (SEQ ID NO: 1103). The guide sequence can then follow (5' to 3') the duplex forming segment.

A non-limiting example of an activator RNA (e.g. tracrRNA) of a C2c1 guide RNA (dual guide or single guide) is an RNA that includes the nucleotide sequence GAAUUUUUCAACGGGUGUGCCAAUGGCCACUUUCCAGGUGGCAAAGCCCGUUGAGCUUCUCAAAAAG (SEQ ID NO: 1104). In some cases, a C2c1 guide RNA (dual guide or single guide) is an RNA that includes the nucleotide sequence In some cases, a C2c1 guide RNA (dual guide or single guide) is an RNA that includes the nucleotide sequence GUCUAGAGGACAGAAUUUUCAACGGGUGUGCCAAUGGCCACUUUCCAGGUGGC AAAGCCCGUUGAGCUUCUCAAAAAG (SEQ ID NO: 1105). In some cases, a C2c1 guide RNA (dual guide or single guide) is an RNA that includes the nucleotide sequence UCUAGAGGACAGAAUUUUUCAACGGGUGUGCCAAUGGCCACUUUCCAGGUGGCA AAGCCCGUUGAGCUUCUCAAAAAG (SEQ ID NO: 1106). A non-limiting example of an activator RNA (e.g. tracrRNA) of a C2c1 guide RNA (dual guide or single guide) is an RNA that includes the nucleotide sequence ACUUUCCAGGCAAAGCCCGUUGAGCUUCUCAAAAAG (SEQ ID NO: 1107). In some cases, a duplex forming segment of a C2c1 guide RNA (dual guide or single guide) of an activator RNA (e.g. tracrRNA) includes the nucleotide sequence AGCUUCUCA or the nucleotide sequence GCUUCUCA (the duplex forming segment from a naturally existing tracrRNA.

A non-limiting example of a targeter RNA (e.g. crRNA) of a C2c1 guide RNA (dual guide or single guide) is an RNA with the nucleotide sequence CUGAGAAGUGGCACNNNNNNNNNNNNNNNNN-NNN (SEQ ID NO: 1110), where the Ns represent the guide sequence, which will vary depending on the target sequence, and although 20 Ns are depicted a range of different lengths are acceptable. In some cases, a duplex forming segment of a C2c1 guide RNA (dual guide or single guide) of a targeter RNA (e.g. crRNA) includes the nucleotide sequence CUGAGAAGUGGCAC (SEQ ID NO: 1111) or includes the nucleotide sequence CUGAGAAGU or includes the nucleotide sequence UGAGAAGUGGCAC (SEQ ID NO: 1113) or includes the nucleotide sequence UGAGAAGU.

Examples and guidance related to type V or type VI CRISPR/Cas endonucleases and guide RNAs (as well as information regarding requirements related to protospacer adjacent motif (PAM) sequences present in targeted nucleic acids) can be found in the art, for example, see Zetsche et al., *Cell.* 2015 Oct. 22; 163 (3): 759-71; Makarova et al., *Nat Rev Microbiol.* 2015 November; 13 (11): 722-36; and Shmakov et al., *Mol Cell.* 2015 Nov. 5; 60 (3): 385-97.

Nucleic Acid Modifications

In some embodiments, a subject nucleic acid (e.g., a DNA or an RNA encoding a fusion polypeptide of the present disclosure; a DNA or RNA encoding an RNA guided endonuclease; a guide RNA, etc.) has one or more modifications, e.g., a base modification, a backbone modification, a sugar modification, etc., to provide the nucleic acid with a new or enhanced feature (e.g., improved stability). A nucleoside is a base-sugar combination. The base portion of the nucleoside is normally a heterocyclic base. The two most common classes of such heterocyclic bases are the purines and the pyrimidines. Nucleotides are nucleosides that further include a phosphate group covalently linked to the sugar portion of the nucleoside. For those nucleosides that include a pentofuranosyl sugar, the phosphate group can be linked to the 2', the 3', or the 5' hydroxyl moiety of the sugar. In forming oligonucleotides, the phosphate groups covalently link adjacent nucleosides to one another to form a linear polymeric compound. In turn, the respective ends of this linear polymeric compound can be further joined to form a circular compound, however, linear compounds are suitable. In addition, linear compounds may have internal nucleotide base complementarity and may therefore fold in a manner as to produce a fully or partially double-stranded compound. Within oligonucleotides, the phosphate groups are commonly referred to as forming the internucleoside backbone of the oligonucleotide. The normal linkage or backbone of RNA and DNA is a 3' to 5' phosphodiester linkage.

Suitable nucleic acid modifications include, but are not limited to: 2'Omethyl modified nucleotides, 2' Fluoro modified nucleotides, locked nucleic acid (LNA) modified nucleotides, peptide nucleic acid (PNA) modified nucleotides, nucleotides with phosphorothioate linkages, and a 5' cap (e.g., a 7-methylguanylate cap (m7G)). Additional details and additional modifications are described below.

In some cases, 2% or more of the nucleotides of a nucleic acid (e.g., a guide RNA, etc.) are modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a subject nucleic acid are modified). In some cases, 2% or more of the nucleotides of a subject guide RNA are modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a subject guide RNA are modified). In some cases, 2% or more of the nucleotides of a guide RNA are modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a guide RNA are modified).

In some cases, the number of nucleotides of a subject nucleic acid nucleic acid (e.g., a guide RNA, etc.) that are modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a subject that are modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that are modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%).

In some cases, one or more of the nucleotides of a nucleic acid (e.g., a guide RNA, etc.) are modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject nucleic acid are modified). In some cases, one or more of the nucleotides of a subject guide RNA are modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject guide RNA are modified). In some cases, one or more of the nucleotides of a guide RNA are modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a guide RNA are modified).

In some cases, 99% or less of the nucleotides of a nucleic acid (e.g., a guide RNA, etc.) are modified (e.g., 99% or less, 95% or less, 90% or less, 85% or less, 80% or less, 75% or less, 70% or less, 65% or less, 60% or less, 55% or less, 50% or less, or 45% or less of the nucleotides of a subject nucleic acid are modified). In some cases, 99% or less of the nucleotides of a subject guide RNA are modified (e.g., e.g., 99% or less, 95% or less, 90% or less, 85% or less, 80% or less, 75% or less, 70% or less, 65% or less, 60% or less, 55% or less, 50% or less, or 45% or less of the nucleotides of a subject guide RNA are modified). In some cases, 99% or less of the nucleotides of a guide RNA are modified (e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA are modified).

In some cases, the number of nucleotides of a nucleic nucleic acid (e.g., a guide RNA, etc.) that are modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a subject guide RNA that are modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that are modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10).

In some cases, 20 or fewer of the nucleotides of a nucleic acid (e.g., a guide RNA, etc.) are modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject nucleic acid are modified). In some cases, 20 or fewer of the nucleotides of a subject guide RNA are modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject guide RNA are modified). In some cases, 20 or fewer of the nucleotides of a guide RNA are modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a guide RNA are modified).

A 2'-O-Methyl modified nucleotide (also referred to as 2'-O-Methyl RNA) is a naturally occurring modification of RNA found in tRNA and other small RNAs that arises as a post-transcriptional modification. Oligonucleotides can be directly synthesized that contain 2'-O-Methyl RNA. This modification increases Tm of RNA: RNA duplexes but results in only small changes in RNA: DNA stability. It is stable with respect to attack by single-stranded ribonucleases and is typically 5 to 10-fold less susceptible to DNases than DNA. It is commonly used in antisense oligos as a means to increase stability and binding affinity to the target message.

In some cases, 2% or more of the nucleotides of a nucleic acid (e.g., a guide RNA, etc.) are 2'-O-Methyl modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a subject nucleic acid are 2'-O-Methyl modified). In some cases, 2% or more of the nucleotides of a subject guide RNA are 2'-O-Methyl modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a subject guide RNA are 2'-O-Methyl modified). In some cases, 2% or more of the nucleotides of a guide RNA are 2'-O-Methyl modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a guide RNA are 2'-O-Methyl modified).

In some cases, the number of nucleotides of a nucleic acid (e.g., a guide RNA, etc.) that are 2'-O-Methyl modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that are 2'-O-Methyl modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that are 2'-O-Methyl modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%).

In some cases, one or more of the nucleotides of a nucleic acid (e.g., a guide RNA, etc.) are 2'-O-Methyl modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject nucleic acid are 2'-O-Methyl modified). In some cases, one or more of the nucleotides of a guide RNA are 2'-O-Methyl modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject guide RNA are 2'-O-Methyl modified). In some cases, one or more of the nucleotides of a guide RNA are 2'-O-Methyl modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a guide RNA are 2'-O-Methyl modified).

In some cases, 99% or less of the nucleotides of a nucleic acid (e.g., a guide RNA, etc.) are 2'-O-Methyl modified (e.g., 99% or less, 95% or less, 90% or less, 85% or less, 80% or less, 75% or less, 70% or less, 65% or less, 60% or less, 55% or less, 50% or less, or 45% or less of the nucleotides of a subject nucleic acid are 2'-O-Methyl modified). In some cases, 99% or less of the nucleotides of a subject guide RNA are 2'-O-Methyl modified (e.g., e.g., 99% or less, 95% or less, 90% or less, 85% or less, 80% or less, 75% or less, 70% or less, 65% or less, 60% or less, 55% or less, 50% or less, or 45% or less of the nucleotides of a subject guide RNA are 2'-O-Methyl modified). In some cases, 99% or less of the nucleotides of a guide RNA are 2'-O-Methyl modified (e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA are 2'-O-Methyl modified).

In some cases, the number of nucleotides of a nucleic acid nucleic acid (e.g., a guide RNA, etc.) that are 2'-O-Methyl modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a subject guide RNA that are 2'-O-Methyl modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that are 2'-O-Methyl modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10).

In some cases, 20 or fewer of the nucleotides of a nucleic acid (e.g., a guide RNA, etc.) are 2'-O-Methyl modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject nucleic acid are 2'-O-Methyl modified). In some cases, 20 or fewer of the nucleotides of a subject guide RNA are 2'-O-Methyl modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject guide RNA are 2'-O-Methyl modified). In some cases, 20 or fewer of the nucleotides of a guide RNA are 2'-O-Methyl modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a guide RNA are 2'-O-Methyl modified).

2' Fluoro modified nucleotides (e.g., 2' Fluoro bases) have a fluorine modified ribose which increases binding affinity (Tm) and also confers some relative nuclease resistance when compared to native RNA. These modifications are commonly employed in ribozymes and siRNAs to improve stability in serum or other biological fluids.

In some cases, 2% or more of the nucleotides of a nucleic acid (e.g., a guide RNA, etc.) are 2' Fluoro modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a subject nucleic acid are 2' Fluoro modified). In some cases, 2% or more of the nucleotides of a subject guide RNA are 2' Fluoro modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a subject guide RNA are 2' Fluoro modified). In some cases, 2% or more of the nucleotides of a guide RNA are 2' Fluoro modified (e.g., 3% or more, 5% or more, 7.5% or more, 10% or more, 15% or more, 20% or more, 25% or more, 30% or more, 35% or more, 40% or more, 45% or more, 50% or more, 55% or more, 60% or more, 65% or more, 75% or more, 80% or more, 85% or more, 90% or more, 95% or more, or 100% of the nucleotides of a guide RNA are 2' Fluoro modified).

In some cases, the number of nucleotides of a nucleic acid nucleic acid (e.g., a guide RNA, etc.) that are 2' Fluoro modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that are 2' Fluoro modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that are 2' Fluoro modified is in a range of from 3% to 100% (e.g., 3% to 100%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 100%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%).

In some cases, one or more of the nucleotides of a nucleic acid (e.g., a guide RNA, etc.) are 2' Fluoro modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject nucleic acid are 2' Fluoro modified). In some cases, one or more of the nucleotides of a subject guide RNA are 2' Fluoro modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a guide RNA are 2' Fluoro modified). In some cases, one or more of the nucleotides of a guide RNA are 2' Fluoro modified (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a guide RNA are 2' Fluoro modified).

In some cases, 99% or less of the nucleotides of a nucleic acid (e.g., a guide RNA, etc.) are 2' Fluoro modified (e.g., 99% or less, 95% or less, 90% or less, 85% or less, 80% or less, 75% or less, 70% or less, 65% or less, 60% or less, 55% or less, 50% or less, or 45% or less of the nucleotides of a subject nucleic acid are 2' Fluoro modified). In some cases, 99% or less of the nucleotides of a subject guide RNA are 2' Fluoro modified (e.g., e.g., 99% or less, 95% or less, 90% or less, 85% or less, 80% or less, 75% or less, 70% or less, 65% or less, 60% or less, 55% or less, 50% or less, or 45% or less of the nucleotides of a subject guide RNA are 2' Fluoro modified). In some cases, 99% or less of the nucleotides of a guide RNA are 2' Fluoro modified (e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA are 2' Fluoro modified).

In some cases, the number of nucleotides of a nucleic acid nucleic acid (e.g., a guide RNA, etc.) that are 2' Fluoro modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a subject guide RNA that are 2' Fluoro modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that are 2' Fluoro modified is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10).

In some cases, 20 or fewer of the nucleotides of a nucleic acid (e.g., a guide RNA, etc.) are 2' Fluoro modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject nucleic acid are 2' Fluoro modified). In some cases, 20 or fewer of the nucleotides of a subject guide RNA are 2' Fluoro modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject guide RNA are 2' Fluoro modified). In some cases, 20 or fewer of the nucleotides of a guide RNA are 2' Fluoro modified (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a guide RNA are 2' Fluoro modified).

LNA bases have a modification to the ribose backbone that locks the base in the C3'-endo position, which favors RNA A-type helix duplex geometry. This modification significantly increases Tm and is also very nuclease resistant. Multiple LNA insertions can be placed in an oligo at any position except the 3'-end. Applications have been described ranging from antisense oligos to hybridization probes to SNP detection and allele specific PCR. Due to the large increase in Tm conferred by LNAs, they also can cause an increase in primer dimer formation as well as self-hairpin formation. In some cases, the number of LNAs incorporated into a single oligo is 10 bases or less.

In some cases, the number of nucleotides of a nucleic acid nucleic acid (e.g., a guide RNA, etc.) that have an LNA base is in a range of from 3% to 99% (e.g., 3% to 99%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 99%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 99%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that have an LNA base is in a range of from 3% to 99% (e.g., 3% to 99%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 99%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 99%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that have an LNA base is in a range of from 3% to 99% (e.g., 3% to 99%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 99%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 99%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%).

In some cases, one or more of the nucleotides of a nucleic acid (e.g., a guide RNA, etc.) have an LNA base (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject nucleic acid have an LNA base). In some cases, one or more of the nucleotides of a subject guide RNA have an LNA base (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject guide RNA have an LNA base). In some cases, one or more of the nucleotides of a guide RNA have an LNA base (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a guide RNA have an LNA base).

In some cases, 99% or less of the nucleotides of a nucleic acid (e.g., a guide RNA, etc.) have an LNA base (e.g., 99% or less, 95% or less, 90% or less, 85% or less, 80% or less, 75% or less, 70% or less, 65% or less, 60% or less, 55% or less, 50% or less, or 45% or less of the nucleotides of a subject nucleic acid have an LNA base). In some cases, 99% or less of the nucleotides of a guide RNA have an LNA base (e.g., e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA have an LNA base). In some cases, 99% or less of the nucleotides of a guide RNA have an LNA base (e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA have an LNA base).

In some cases, the number of nucleotides of a nucleic acid nucleic acid (e.g., a guide RNA, etc.) that have an LNA base is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that have an LNA base is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that have an LNA base is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10).

In some cases, 20 or fewer of the nucleotides of a nucleic acid (e.g., a guide RNA, etc.) have an LNA base (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject nucleic acid have an LNA base). In some cases, 20 or fewer of the nucleotides of a subject guide RNA have an LNA base (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject guide RNA have an LNA base). In some cases, 20 or fewer of the nucleotides of a guide RNA have an LNA base (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a guide RNA have an LNA base).

The phosphorothioate (PS) bond (i.e., a phosphorothioate linkage) substitutes a sulfur atom for a non-bridging oxygen in the phosphate backbone of a nucleic acid (e.g., an oligo). This modification renders the internucleotide linkage resistant to nuclease degradation. Phosphorothioate bonds can be introduced between the last 3-5 nucleotides at the 5'- or 3'-end of the oligo to inhibit exonuclease degradation. Including phosphorothioate bonds within the oligo (e.g., throughout the entire oligo) can help reduce attack by endonucleases as well.

In some cases, the number of nucleotides of a nucleic acid nucleic acid (e.g., a guide RNA, etc.) that have a phosphorothioate linkage is in a range of from 3% to 99% (e.g., 3% to 99%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 99%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 99%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that have a phosphorothioate linkage is in a range of from 3% to 99% (e.g., 3% to 99%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 99%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 99%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%). In some cases, the number of nucleotides of a guide RNA that have a phosphorothioate linkage is in a range of from 3% to 99% (e.g., 3% to 99%, 3% to 95%, 3% to 90%, 3% to 85%, 3% to 80%, 3% to 75%, 3% to 70%, 3% to 65%, 3% to 60%, 3% to 55%, 3% to 50%, 3% to 45%, 3% to 40%, 5% to 99%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 10% to 99%, 10% to 95%, 10% to 90%, 10% to 85%, 10% to 80%, 10% to 75%, 10% to 70%, 10% to 65%, 10% to 60%, 10% to 55%, 10% to 50%, 10% to 45%, or 10% to 40%).

In some cases, one or more of the nucleotides of a nucleic acid (e.g., a guide RNA, etc.) have a phosphorothioate linkage (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject nucleic acid have a phosphorothioate linkage). In some cases, one or more of the nucleotides of a subject guide RNA have a phosphorothioate linkage (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a subject guide RNA have a phosphorothioate linkage). In some cases, one or more of the nucleotides of a guide RNA have a phosphorothioate linkage (e.g., 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, or all of the nucleotides of a guide RNA have a phosphorothioate linkage).

In some cases, 99% or less of the nucleotides of a nucleic acid (e.g., a guide RNA, etc.) have a phosphorothioate linkage (e.g., 99% or less, 95% or less, 90% or less, 85% or less, 80% or less, 75% or less, 70% or less, 65% or less, 60% or less, 55% or less, 50% or less, or 45% or less of the nucleotides of a subject nucleic acid have a phosphorothioate linkage). In some cases, 99% or less of the nucleotides of a subject guide RNA have a phosphorothioate linkage (e.g., e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA have a phosphorothioate linkage). In some cases, 99% or less of the nucleotides of a guide RNA have a phosphorothioate linkage (e.g., 99% or less, 95% or less, 90% or less, 85% or less, 80% or less, 75% or less, 70% or less, 65% or less, 60% or less, 55% or less, 50% or less, or 45% or less of the nucleotides of a guide RNA have a phosphorothioate linkage).

In some cases, the number of nucleotides of a nucleic acid nucleic acid (e.g., a guide RNA, etc.) that have a phosphorothioate linkage is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that have a phosphorothioate linkage is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10). In some cases, the number of nucleotides of a guide RNA that have a phosphorothioate linkage is in a range of from 1 to 30 (e.g., 1 to 25, 1 to 20, 1 to 18, 1 to 15, 1 to 10, 2 to 25, 2 to 20, 2 to 18, 2 to 15, 2 to 10, 3 to 25, 3 to 20, 3 to 18, 3 to 15, or 3 to 10).

In some cases, 20 or fewer of the nucleotides of a nucleic acid (e.g., a guide RNA, etc.) have a phosphorothioate linkage (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject nucleic acid have a phosphorothioate linkage). In some cases, 20 or fewer of the nucleotides of a guide RNA have a phosphorothioate linkage (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a subject guide RNA have a phosphorothioate linkage). In some cases, 20 or fewer of the nucleotides of a guide RNA have a phosphorothioate linkage (e.g., 19 or fewer, 18 or fewer, 17 or fewer, 16 or fewer, 15 or fewer, 14 or fewer, 13 or fewer, 12 or fewer, 11 or fewer, 10 or fewer, 9 or fewer, 8 or fewer, 7 or fewer, 6 or fewer, 5 or fewer, 4 or fewer, 3 or fewer, 2 or fewer, or one, of the nucleotides of a guide RNA have a phosphorothioate linkage).

In some cases, a nucleic acid (e.g., a guide RNA, etc.) has one or more nucleotides that are 2'-O-Methyl modified nucleotides. In some embodiments, a subject nucleic acid (e.g., a guide RNA, etc.) has one or more 2' Fluoro modified nucleotides. In some cases, a subject nucleic acid (e.g., a guide RNA, etc.) has one or more LNA bases. In some cases, a subject nucleic acid (e.g., a guide RNA, etc.) has one or more nucleotides that are linked by a phosphorothioate bond (i.e., the subject nucleic acid has one or more phosphorothioate linkages). In some embodiments, a subject nucleic acid (e.g., a guide RNA, etc.) has a 5' cap (e.g., a 7-methylguanylate cap (m7G)).

In some cases, a nucleic acid (e.g., a DNA or RNA encoding an RNA guided endonuclease, a guide RNA, etc.) has a combination of modified nucleotides. For example, a nucleic acid can have a 5' cap (e.g., a 7-methylguanylate cap (m7G)) in addition to having one or more nucleotides with other modifications (e.g., a 2'-O-Methyl nucleotide and/or a 2' Fluoro modified nucleotide and/or a LNA base and/or a phosphorothioate linkage). A nucleic acid can have any combination of modifications. For example, a subject nucleic acid can have any combination of the above described modifications.

In some cases, a guide RNA has one or more nucleotides that are 2'-O-Methyl modified nucleotides. In some embodiments, a guide RNA has one or more 2' Fluoro modified nucleotides. In some embodiments, a guide RNA has one or more LNA bases. In some embodiments, a guide RNA has one or more nucleotides that are linked by a phosphorothioate bond (i.e., the subject nucleic acid has one or more phosphorothioate linkages). In some embodiments, a guide RNA has a 5' cap (e.g., a 7-methylguanylate cap (m7G)).

In some cases, a guide RNA has a combination of modified nucleotides. For example, a guide RNA can have a 5' cap (e.g., a 7-methylguanylate cap (m7G)) in addition to having one or more nucleotides with other modifications (e.g., a 2'-O-Methyl nucleotide and/or a 2' Fluoro modified nucleotide and/or a LNA base and/or a phosphorothioate linkage). A guide RNA can have any combination of modifications. For example, a guide RNA can have any combination of the above described modifications.

Modified Backbones and Modified Internucleoside Linkages

Examples of suitable nucleic acids containing modifications include nucleic acids containing modified backbones or non-natural internucleoside linkages. Nucleic acids having modified backbones include those that retain a phosphorus atom in the backbone and those that do not have a phosphorus atom in the backbone.

Suitable modified oligonucleotide backbones containing a phosphorus atom therein include, for example, phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, phosphorodiamidates, thionophosphoramidates, thionoalkylphosphonates, thionoalkylphosphotriesters, selenophosphates and boranophosphates having normal 3'-5' linkages, 2'-5' linked analogs of these, and those having inverted polarity wherein one or more internucleotide linkages is a 3' to 3', 5' to 5' or 2' to 2' linkage. Suitable oligonucleotides having inverted polarity comprise a single 3' to 3' linkage at the 3'-most internucleotide linkage i.e. a single inverted nucleoside residue which may be a basic (the nucleobase is missing or has a hydroxyl group in place thereof). Various salts (such as, for example, potassium or sodium), mixed salts and free acid forms are also included.

In some cases, a nucleic acid comprises one or more phosphorothioate and/or heteroatom internucleoside linkages, in particular —$CH_2$—NH—O—$CH_2$—, —$CH_2$—N($CH_3$)—O—$CH_2$— (known as a methylene (methylimino) or MMI backbone), —$CH_2$—O—N($CH_3$)—$CH_2$—, —$CH_2$—N($CH_3$)—N($CH_3$)—$CH_2$- and —O—N($CH_3$)—$CH_2$—$CH_2$— (wherein the native phosphodiester internucleotide linkage is represented as —O—P(=O) (OH)—O—$CH_2$—). MMI type internucleoside linkages are disclosed in the above referenced U.S. Pat. No. 5,489,677. Suitable amide internucleoside linkages are disclosed in t U.S. Pat. No. 5,602,240.

Also suitable are nucleic acids having morpholino backbone structures as described in, e.g., U.S. Pat. No. 5,034,506. For example, in some embodiments, a subject nucleic acid comprises a 6-membered morpholino ring in place of a ribose ring. In some of these embodiments, a phosphorodiamidate or other non-phosphodiester internucleoside linkage replaces a phosphodiester linkage.

Suitable modified polynucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Mimetics

A nucleic acid can be a nucleic acid mimetic. The term "mimetic" as it is applied to polynucleotides is intended to include polynucleotides wherein only the furanose ring or both the furanose ring and the internucleotide linkage are replaced with non-furanose groups, replacement of only the furanose ring is also referred to in the art as being a sugar surrogate. The heterocyclic base moiety or a modified heterocyclic base moiety is maintained for hybridization with an appropriate target nucleic acid. One such nucleic acid, a polynucleotide mimetic that has been shown to have excellent hybridization properties, is referred to as a peptide nucleic acid (PNA). In PNA, the sugar-backbone of a polynucleotide is replaced with an amide containing backbone, in particular an aminoethylglycine backbone. The nucleotides are retained and are bound directly or indirectly to aza nitrogen atoms of the amide portion of the backbone.

One polynucleotide mimetic that has been reported to have excellent hybridization properties is a peptide nucleic acid (PNA). The backbone in PNA compounds is two or more linked aminoethylglycine units which gives PNA an amide containing backbone. The heterocyclic base moieties are bound directly or indirectly to aza nitrogen atoms of the amide portion of the backbone. Representative U.S. patents that describe the preparation of PNA compounds include, but are not limited to: U.S. Pat. Nos. 5,539,082; 5,714,331; and 5,719,262.

Another class of polynucleotide mimetic that has been studied is based on linked morpholino units (morpholino nucleic acid) having heterocyclic bases attached to the morpholino ring. A number of linking groups have been reported that link the morpholino monomeric units in a morpholino nucleic acid. One class of linking groups has been selected to give a non-ionic oligomeric compound. The non-ionic morpholino-based oligomeric compounds are less likely to have undesired interactions with cellular proteins. Morpholino-based polynucleotides are non-ionic mimics of oligonucleotides which are less likely to form undesired interactions with cellular proteins (Dwaine A. Braasch and David R. Corey, Biochemistry, 2002, 41 (14), 4503-4510). Morpholino-based polynucleotides are disclosed in U.S. Pat. No. 5,034,506. A variety of compounds within the morpholino class of polynucleotides have been prepared, having a variety of different linking groups joining the monomeric subunits.

A further class of polynucleotide mimetic is referred to as cyclohexenyl nucleic acids (CeNA). The furanose ring normally present in a DNA/RNA molecule is replaced with a cyclohexenyl ring. CeNA DMT protected phosphoramidite monomers have been prepared and used for oligomeric compound synthesis following classical phosphoramidite chemistry. Fully modified CeNA oligomeric compounds and oligonucleotides having specific positions modified with CeNA have been prepared and studied (see Wang et al., J. Am. Chem. Soc., 2000, 122, 8595-8602). In general the incorporation of CeNA monomers into a DNA chain increases its stability of a DNA/RNA hybrid. CeNA oligoadenylates formed complexes with RNA and DNA complements with similar stability to the native complexes. The study of incorporating CeNA structures into natural nucleic acid structures was shown by NMR and circular dichroism to proceed with easy conformational adaptation.

A further modification includes Locked Nucleic Acids (LNAs) in which the 2'-hydroxyl group is linked to the 4' carbon atom of the sugar ring thereby forming a 2'-C,4'-C-oxymethylene linkage thereby forming a bicyclic sugar moiety. The linkage can be a methylene (—CH$_2$—), group bridging the 2' oxygen atom and the 4' carbon atom wherein n is 1 or 2 (Singh et al., Chem. Commun., 1998, 4, 455-456). LNA and LNA analogs display very high duplex thermal stabilities with complementary DNA and RNA (Tm=±3 to +10° C.), stability towards 3'-exonucleolytic degradation and good solubility properties. Potent and nontoxic antisense oligonucleotides containing LNAs have been described (e.g., Wahlestedt et al., Proc. Natl. Acad. Sci. U.S.A., 2000, 97, 5633-5638).

The synthesis and preparation of the LNA monomers adenine, cytosine, guanine, 5-methyl-cytosine, thymine and uracil, along with their oligomerization, and nucleic acid recognition properties have been described (e.g., Koshkin et al., Tetrahedron, 1998, 54, 3607-3630). LNAs and preparation thereof are also described in WO 98/39352 and WO 99/14226, as well as U.S. applications 20120165514, 20100216983, 20090041809, 20060117410, 20040014959, 20020094555, and 20020086998.

Modified Sugar Moieties

A nucleic acid can also include one or more substituted sugar moieties. Suitable polynucleotides comprise a sugar substituent group selected from: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly suitable are O((CH$_2$)$_n$O) $_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON((CH$_2$)$_n$CH$_3$)$_2$, where n and m are from 1 to about 10. Other suitable polynucleotides comprise a sugar substituent group selected from: $C_1$ to $C_{10}$ lower alkyl, substituted lower alkyl, alkenyl, alkynyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A suitable modification includes 2'-methoxyethoxy (2'-O—CH$_2$ CH$_2$OCH$_3$, also known as 2'-O-(2-methoxyethyl) or 2'-MOE) (Martin et al., Helv. Chim. Acta, 1995, 78, 486-504) i.e., an alkoxyalkoxy group. A further suitable modification includes 2'-dimethylaminooxyethoxy, i.e., a O(CH$_2$)$_2$ ON(CH$_3$)$_2$ group, also known as 2'-DMAOE, as described in examples herein below, and 2'-dimethylaminoethoxyethoxy (also known in the art as 2'-O-dimethyl-amino-ethoxy-ethyl or 2'-DMAEOE), i.e., 2'-O—CH$_2$—O—CH$_2$—N(CH$_3$)$_2$.

Other suitable sugar substituent groups include methoxy (—O—CH$_3$), aminopropoxy (—O CH$_2$ CH$_2$ CH$_2$NH$_2$), allyl (—CH$_2$—CH═CH$_2$), —O-allyl (—O—CH$_2$—CH═CH$_2$) and fluoro (F). 2'-sugar substituent groups may be in the arabino (up) position or ribo (down) position. A suitable 2'-arabino modification is 2'-F. Similar modifications may also be made at other positions on the oligomeric compound, particularly the 3' position of the sugar on the 3' terminal nucleoside or in 2'-5' linked oligonucleotides and the 5' position of 5' terminal nucleotide. Oligomeric compounds may also have sugar mimetics such as cyclobutyl moieties in place of the pentofuranosyl sugar.

Base Modifications and Substitutions

A nucleic acid may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C)

and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH₃) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified nucleobases include tricyclic pyrimidines such as phenoxazine cytidine(1H-pyrimido(5,4-b)(1,4)benzoxazin-2 (3H)-one), phenothiazine cytidine (1H-pyrimido(5,4-b)(1,4) benzothiazin-2(3H)-one), G-clamps such as a substituted phenoxazine cytidine (e.g. 9-(2-aminoethoxy)-H-pyrimido (5,4-(b) (1,4)benzoxazin-2(3H)-one), carbazole cytidine (2H-pyrimido(4,5-b)indol-2-one), pyridoindole cytidine (H-pyrido(3',2':4,5)pyrrolo(2,3-d)pyrimidin-2-one).

Heterocyclic base moieties may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, those disclosed by Englisch et al., Angewandte Chemie, International Edition, 1991, 30, 613, and those disclosed by Sanghvi, Y. S., Chapter 15, Antisense Research and Applications, pages 289-302, Crooke, S. T. and Lebleu, B., ed., CRC Press, 1993. Certain of these nucleobases are useful for increasing the binding affinity of an oligomeric compound. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi et al., eds., Antisense Research and Applications, CRC Press, Boca Raton, 1993, pp. 276-278) and are suitable base substitutions, e.g., when combined with 2'-O-methoxyethyl sugar modifications.

Error-Prone DNA Polymerases

A number of error-prone DNA polymerases are known in the art, and any known error-prone DNA polymerase is suitable for use in a fusion polypeptide of the present disclosure. A suitable error-prone DNA polymerase possesses nick translating activity.

Suitable error-prone DNA polymerases include, but are not limited to, Taq polymerase, *Thermus flavus* DNA polymerase I, *Thermus thermophilus* HB-8 DNA polymerase I, *Thermophilus ruber* DNA polymerase I, *Thermophilus brokianus* DNA polymerase I, *Thermophilus caldophilus* GK14 DNA polymerase I, *Thermophilus filoformis* DNA polymerase I, *Bacillus stearothermophilus* DNA polymerase I, *Bacillus caldotonex* YT-G DNA polymerase I, and *Bacillus caldovelox* YT-F DNA polymerase I. Suitable error-prone DNA polymerases include, but are not limited to, a *Niastella koreensis* error-prone DNA polymerase, a *Mucilaginibacter paludis* error-prone DNA polymerase, a *Methylobacterium extorquens* error-prone DNA polymerase, and a *Stenotrophomonas maltophilia* error-prone DNA polymerase.

In some cases, a suitable error-prone DNA polymerase is *Escherichia coli* DNA polymerase I, with three fidelity-reducing mutations; this error-prone DNA polymerase is referred to as PolI3M. PolI3M comprises D424A, I709N, and A759R substitutions relative to wild-type *E. coli* DNA polymerase I. In some cases, a suitable error-prone DNA polymerase comprises an amino acid sequence having at least 85%, at least 90%, at least 95%, at least 98%, at least 99%, or 100%, amino acid sequence identity to the DNA polymerase I amino acid sequence depicted in FIG. 8; where the DNA polymerase has an Ala at amino acid position 424, an Asn at amino acid position 709, and an Arg at amino acid position 759 of the amino acid sequence depicted in FIG. 8, or a corresponding amino acid in another DNA polymerase.

In some cases, a suitable error-prone DNA polymerase is *Escherichia coli* DNA polymerase I, with five fidelity-reducing mutations: D242A, I709N, A759R, F742Y, and P796H. In some cases, a suitable error-prone DNA polymerase comprises an amino acid sequence having at least 85%, at least 90%, at least 95%, at least 98%, at least 99%, or 100%, amino acid sequence identity to the DNA polymerase I amino acid sequence depicted in FIG. 8; where the DNA polymerase has an Ala at amino acid position 242, an Asn at amino acid position 709, an Arg at amino acid position 759, a Tyr at amino acid position 742, and a His at amino acid position 796; or corresponding amino acids in another DNA polymerase.

In some cases, a suitable error-prone DNA polymerase comprises an amino acid sequence having at least 85%, at least 90%, at least 95%, at least 98%, or at least 99%, amino acid sequence identity to the DNA polymerase I amino acid sequence depicted in FIG. 8; where the DNA polymerase has an Ala at amino acid position 424, and an Asn at amino acid position 709.

In some cases, a suitable error-prone DNA polymerase comprises an amino acid sequence having at least 85%, at least 90%, at least 95%, at least 98%, at least 99%, or 100%, amino acid sequence identity to the DNA polymerase I amino acid sequence depicted in FIG. 9.

In some cases, a suitable error-prone DNA polymerase comprises an amino acid sequence having at least 85%, at least 90%, at least 95%, at least 98%, at least 99%, or 100%, amino acid sequence identity to the DNA polymerase I amino acid sequence depicted in FIG. 10.

In some cases, a suitable error-prone DNA polymerase comprises an amino acid sequence having at least 85%, at least 90%, at least 95%, at least 98%, at least 99%, or 100%, amino acid sequence identity to the DNA polymerase I amino acid sequence depicted in FIG. 11.

In some cases, a suitable error-prone DNA polymerase comprises an amino acid sequence having at least 85%, at least 90%, at least 95%, at least 98%, at least 99%, or 100%, amino acid sequence identity to the DNA polymerase iota amino acid sequence depicted in FIG. 13.

In some cases, a suitable error-prone DNA polymerase comprises an amino acid sequence having at least 85%, at least 90%, at least 95%, at least 98%, at least 99%, or 100%, amino acid sequence identity to the DNA polymerase q amino acid sequence depicted in FIGS. 14A-14B.

In some cases, a suitable error-prone DNA polymerase comprises an amino acid sequence having at least 85%, at least 90%, at least 95%, at least 98%, at least 99%, or 100%, amino acid sequence identity to the DNA polymerase K amino acid sequence depicted in FIGS. 15A-15B.

In some cases, a suitable error-prone DNA polymerase comprises an amino acid sequence having at least 85%, at least 90%, at least 95%, at least 98%, at least 99%, or 100%, amino acid sequence identity to the DNA polymerase 0 amino acid sequence depicted in FIGS. 16A-16D.

In some cases, a suitable error-prone DNA polymerase comprises an amino acid sequence having at least 85%, at least 90%, at least 95%, at least 98%, at least 99%, or 100%, amino acid sequence identity to the DNA polymerase v (nu) amino acid sequence depicted in FIGS. 17A-17B.

In some cases, a suitable error-prone DNA polymerase comprises an amino acid sequence having at least 85%, at least 90%, at least 95%, at least 98%, at least 99%, or 100%, amino acid sequence identity to the E. coli DNA polymerase IV amino acid sequence depicted in FIG. 18.

In some cases, a suitable error-prone DNA polymerase comprises an amino acid sequence having at least 85%, at least 90%, at least 95%, at least 98%, at least 99%, or 100%, amino acid sequence identity to a DNA polymerase R having the following amino acid sequence:

```
                                         (SEQ ID NO: 1163)
MSKRKAPQETLNGGITDMLTELANFEKNVSQAIHKYNAYR

KAASVIAKYPHKIKSGAEAKKLPGVGTKIAEKIDEFLATG

KLRKLEKIRQDDTSSSINFLTRVSGIGPSAARKFVDEGIK

TLEDLRKNEDKLNHHQRIGLKYFGDFEKRIPREEMLQMQD

IVLNEVKKVDSEYIATVCGSFRRGAESSGDMDVLLTHPSF

TSESTKQPKLLHQVVEQLQKVHFITDTLSKGETKFMGVCQ

LPSKNDEKEYPHRRIDIRLIPKDQYYCGVLYFTGSDIFNK

NMRAHALEKGFTINEYTIRPLGVTGVAGEPLPVDSEKDIF

DYIQWKYREPKDRSE.
```

In some cases, a suitable error-prone DNA polymerase comprises an amino acid sequence having at least 85%, at least 90%, at least 95%, at least 98%, at least 99%, or 100%, amino acid sequence identity to a DNA polymerase iota having the following amino acid sequence: MEKLGVEPEEEGGGDDDEEDAEAWAMELADVGAAASSQGVHDQVLPTPNASSRVIVH VDLDCFYAQVEMISNPELKDKPLGVQQKYLVVTCNYEARKLGVKKLMNVRDAKEKCP QLVLVNGEDLTRYREMSYKVTELLEEFSPVVERLGFDENFVDLTEMVEKRLQQLQSDE LSAVTVSGHVYNNQSINLLDVLHIRLLVGSQIAAEMREAMYNQLGLTGCAGVASNKLL AKLVSGVFKPNQQTVLLPESCQHLIHSLNHIKEIPGIGYKTAKCLEALGINSVRDLQTFSP KILEKELGISVAQRIQKLSFGEDNSPVILSGPPQSFSEEDSFKKCSSEVEAKNKIEELLASLL NRVCQDGRKPHTVRLIIRRYSSEKHYGRESRQCPIPSHVIQKLGTGNYDVMTPMVDILM KLFRNMVNVKMPFHLTLLSVCFCNLKALNTAKKGLIDYYLMPSLSTTSRSGKHSFKMK DTHMEDFPKDKETNRDFLPSGRIESTRTRESPLDTTNFSKEKDINEFPLCSLPEGVDQEVF KQLPVDIQEEILSGKSREKFQGKGSVSCPLHASRGVLSFFSKKQMQDIPINPRDHLSSSKQ VSSVSPCEPGTSGFNSSSSSYMSSQKDYSYYLDNRLKDERISQGPKEPQGFHFTNSNPAV SAFHSFPNLQSEQLFSRNHTTDSHKQTVATDSHEGLTENREPDSVDEKITFPSDIDPQVFY ELPEAVQKELLAEWKRAGSDFHIGHK (SEQ ID NO:1164). In some cases, such a DNA polymerase generates T→G substitutions.

In some cases, a suitable error-prone DNA polymerase comprises an amino acid sequence having at least 85%, at least 90%, at least 95%, at least 98%, at least 99%, or 100%, amino acid sequence identity to a DNA polymerase iota having the following amino acid sequence (amino acids 1-445 of DNA polymerase iota): MEKLGVEPEEEGGGDDDEEDAEAWAMELADVGAAASSQGVHDQVLPTPNASSRVIVH VDLDCFYAQVEMISNPELKDKPLGVQQKYLVVTCNYEARKLGVKKLMNVRDAKEKCP QLVLVNGEDLTRYREMSYKVTELLEEFSPVVERLGFDENFVDLTEMVEKRLQQLQSDE LSAVTVSGHVYNNQSINLLDVLHIRLLVGSQIAAEMREAMYNQLGLTGCAGVASNKLL AKLVSGVFKPNQQTVLLPESCQHLIHSLNHIKEIPGIGYKTAKCLEALGINSVRDLQTFSP KILEKELGISVAQRIQKLSFGEDNSPVILSGPPQSFSEEDSFKKCSSEVEAKNKIEELLASLL NRVCQDGRKPHTVRLIIRRYSSEKHYGRESRQCPIPSHVIQKLGTGNYDVMTPMVDILM KLFRNMVNVKMPFHLTLLSVCFCNLKALNTAK (SEQ ID NO:1165); and having a length of 445 amino acids. In some cases, such a DNA polymerase generates T→G substitutions. In some cases, such a DNA polymerase has a T→G error rate approaching 1.

In some cases, a suitable error-prone DNA polymerase comprises an amino acid sequence having at least 85%, at least 90%, at least 95%, at least 98%, at least 99%, or 100%, amino acid sequence identity to a DNA polymerase iota having the following amino acid sequence (amino acids 26-445 of DNA polymerase iota): ELADVGAAASSQGVHDQVLPTPNASSRVIVHVDLDCFYAQVEMISNPELKDKPLGVQQ KYLVVTCNYEARKLGVKKLMNVRDAKEKCPQLVLVNGEDLTRYREMSYKVTELLEEF SPVVERLGFDENFVDLTEMVEKRLQQLQSDELSAVTVSGHVYNNQSINLLDVLHIRLLV GSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILS GPPQSFSEEDSFKKCSSEVEAKNKIEELLASLLNRVCQDGRKPHTVRLIIRRYSSEKHYGR ESRQCPIPSHVIQKLGTGNYDVMTPMVDILMKLFRNMVNVKMPFHLTLLSVCFCNLKA LNTAK (SEQ ID NO:1166); and having a length of 419 amino acids. In some cases, such a DNA polymerase generates T→G substitutions. In some cases, such a DNA polymerase has a T→G error rate approaching 1.

In some cases, a suitable error-prone DNA polymerase comprises an amino acid sequence having at least 85%, at least 90%, at least 95%, at least 98%, at least 99%, or 100%, amino acid sequence identity to a DNA polymerase nu (v) having the following amino acid sequence: ENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIP QYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQ EAHQQFARNVLFQTMKCKCPVICFNAKDFVRIVLQFFGNDGSWKHVADFIGLDPRIAA WLIDPSDATPSFEDLVEKYCEKSITVKVNSTYGNSSRNIVNQNVRENLKTLYRLTMDLCS KLKDYGLWQLFRTLELPLIPILAVMESHAIQVNKEEMEKTSALLGARLKELEQEAHFVA GERFLITSNNQLREILFGKL- KLHLLSQRNSLPRTGLQKYPSTSEAVLNALRDLHPLPKIILE YRQVHKIKSTFVDGLLACMKKGSISSTWNQTGTVTGRLSAKHPNIQGISKHPIQITTPKN FKGKEDKILTISPRAMFVSSKGHTFLAADFSQIELRILTHLSGDPELLKLFQESERDDVFST LTSQWKDVPVEQVTHADREQTKKVVYAVVYGAGKERLAACLGVPIQEAAQFLESFLQ KYKKIKDFARAAIAQCHQTGCVVSIMGRRRPLPRIHAHDQQLRAQAERQAVNFVVQGS AADLCK- LAMIHVFTAVAASHTLTARLVAQIHDELLFEVEDPQIPECAALVRRTMESLEQ VQALELQLQVPLKVSLSAGRSWGHLVPLQEAWGPPPGPCRTESPSNSLAAPGSPASTQP PPLHFSPSFCL (SEQ ID NO:1167). In some cases, such a DNA polymerase generates G→T substitutions.

In some cases, a suitable error-prone DNA polymerase comprises an amino acid sequence having at least 85%, at least 90%, at least 95%, at least 98%, at least 99%, or 100%, amino acid sequence identity to a DNA polymerase eta (η) having the following amino acid sequence:

(SEQ ID NO: 1168)
MATGQDRVVALVDMDCFFVQVEQRQNPHLRNKPCAVVQYK

SWKGGGIIAVSYEARAFGVTRSMWADDAKKLCPDLLLAQV

RESRGKANLTKYREASVEVMEIMSRFAVIERASIDEAYVD

LTSAVQERLQKLQGQPISADLLPSTYIEGLPQGPTTAEET

VQKEGMRKQGLFQWLDSLQIDNLTSPDLQLTVGAVIVEEM

RAAIERETGFQCSAGISHNKVLAKLACGLNKPNRQTLVSH

GSVPQLFSQMPIRKIRSLGGKLGASVIEILGIEYMGELTQ

FTESQLQSHFGEKNGSWLYAMCRGIEHDPVKPRQLPKTIG

CSKNFPGKTALATREQVQWWLLQLAQELEERLTKDRNDND

RVATQLVVSIRVQGDKRLSSLRRCCALTRYDAHKMSHDAF

TVIKNCNTSGIQTEWSPPLTMLFLCATKFSASAPSSSTDI

TSFLSSDPSSLPKVPVTSSEAKTQGSGPAVTATKKATTSL

ESFFQKAAERQKVKEASLSSLTAPTQAPMSNSPSKPSLPF

QTSQSTGTEPFFKQKSLLLKQKQLNNSSVSSPQQNPWSNC

KALPNSLPTEYPGCVPVCEGVSKLEESSKATPAEMDLAHN

SQSMHASSASKSVLEVTQKATPNPSLLAAEDQVPCEKCGS

LVPVWDMPEHMDYHFALELQKSFLQPHSSNPQVVSAVSHQ

GKRNPKSPLACTNKRPRPEGMQTLESFFKPLTH.

In some cases, a suitable error-prone DNA polymerase comprises an amino acid sequence having at least 85%, at least 90%, at least 95%, at least 98%, at least 99%, or 100%, amino acid sequence identity to a DNA polymerase eta (η) having the following amino acid sequence: MATGQDRVVALVDMDCFFVQVEQRQNPHLRNKPCAVVQYKSWKGGGIIAVSYEARAF GVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQS HFGEKNG SWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSN (SEQ ID NO:1169); and has a length of 511 amino acids.

In some cases, a suitable error-prone DNA polymerase comprises an amino acid sequence having at least 85%, at least 90%, at least 95%, at least 98%, at least 99%, or 100%, amino acid sequence identity to a DNA polymerase kappa (κ) having the following amino acid sequence:

(SEQ ID NO: 1170)
MDSTKEKCDSYKDDLLLRMGLNDNKAGMEGLDKEKINKII

MEATKGSRFYGNELKKEKQVNQRIENMMQQKAQITSQQLR

KAQLQVDRFAMELEQSRNLSNTIVHIDMDAFYAAVEMRDN

PELKDKPIAVGSMSMLSTSNYHARRFGVRAAMPGFIAKRL

CPQLIIVPPNFDKYRAVSKEVKEILADYDPNFMAMSLDEA

YLNITKHLEERQNWPEDKRRYFIKMGSSVENDNPGKEVNK

LSEHERSISPLLFEESPSDVQPPGDPFQVNFEEQNNPQIL

QNSVVFGTSAQEVVKEIRFRIEQKTTLTASAGIAPNTMLA

KVCSDKNKPNGQYQILPNRQAVMDFIKDLPIRKVSGIGKV

TEKMLKALGIITCTELYQQRALLSLLFSETSWHYFLHISL

GLGSTHLTRDGERKSMSVERTFSEINKAEEQYSLCQELCS

ELAQDLQKERLKGRTVTIKLKNVNFEVKTRASTVSSVVST

AEEIFAIAKELLKTEIDADFPHPLRLRLMGVRISSFPNEE

DRKHQQRSIIGFLQAGNQALSATECTLEKTDKDKFVKPLE

MSHKKSFFDKKRSERKWSHQDTFKCEAVNKQSFQTSQPFQ

VLKKKMNENLEISENSDDCQILTCPVCFRAQGCISLEALN

KHVDECLDGPSISENFKMFSCSHVSATKVNKKENVPASSL

CEKQDYEAHPKIKEISSVDCIALVDTIDNSSKAESIDALS

NKHSKEECSSLPSKSFNIEHCHQNSSSTVSLENEDVGSFR

QEYRQPYLCEVKTGQALVCPVCNVEQKTSDLTLFNVHVDV

CLNKSFIQELRKDKFNPVNQPKESSRSTGSSSGVQKAVTR

TKRPGLMTKYSTSKKIKPNNPKHTLDIFFK.

In some cases, a suitable error-prone DNA polymerase comprises an amino acid sequence having at least 85%, at least 90%, at least 95%, at least 98%, at least 99%, or 100%, amino acid sequence identity to a DNA polymerase kappa (κ) having the following amino acid sequence: MDSTKEKCDSYKDDLLLRMGLNDNKAGMEGLDKEKINKIIMEATKGSRFYGNELKKE KQVNQRIENMMQQKAQITSQQLRKAQLQVDRFAMELEQSRNLSNTIVHIDMDAFYAAV EMRDNPELKDKPIAVGSMSMLSTSNYHARRFGVRAAMPGFIAKRLCPQLIIVPPNFDKY RAVSKEVKEILADYDPNFMAMSLDEAYLNITKHLEERQNWPEDKRRYFIKMGSSVEND NPGKEVNK- LSEHERSISPLLFEESPSDVQPPGDPFQVNFEEQNNPQILQNSVVFGTSAQEV VKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGER KSMSVERTFSEINKAEEQYSLCQELCSELAQDLQKERLKGRTVTIKLKNVNFEVKTRAST VSSVVSTAEEIFAIAKELLKTEIDADFPHPLRLRLMGVRISSFPNEEDRKHQQRSIIGFLQA GNQALSATECTLEKTDKDKFVKPLE (SEQ ID NO:1171); and has a length of 560 amino acids.

Linkers

In some cases, a fusion polypeptide of the present disclosure comprises a linker positioned between the DNA polymerase and the RNA-guided endonuclease.

In some embodiments, a subject fusion polypeptide can be fused to a fusion partner via a linker polypeptide (e.g., one or more linker polypeptides). The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers can be produced by using synthetic, linker-encoding oligonucleotides to couple the proteins, or can be encoded by a nucleic acid sequence encoding the fusion protein. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use.

Examples of linker polypeptides include glycine polymers $(G)_n$, glycine-serine polymers (including, for example, $(GS)_n$, $(GSGGS)_n$ (SEQ ID NO:1154), $(GGSGGS)_n$ (SEQ ID NO:1155), and $(GGGS)_n$ (SEQ ID NO:1156), where n is an integer of at least one), glycine-alanine polymers, alanine-serine polymers. Exemplary linkers can comprise amino acid sequences including, but not limited to, GGSG (SEQ ID NO:1157), GGSGG (SEQ ID NO:1158), GSGSG (SEQ ID NO:1159), GSGGG (SEQ ID NO:1160), GGGSG (SEQ ID NO:1161), GSSSG (SEQ ID NO:1162), and the like. The ordinarily skilled artisan will recognize that design of a peptide conjugated to any desired element can include linkers that are all or partially flexible, such that the linker can include a flexible linker as well as one or more portions that confer less flexible structure.

Additional Polypeptides

A fusion polypeptide of the present disclosure can comprise one or more additional polypeptides. Suitable additional polypeptides include, but are not limited to, a nuclear localization signal (NLS); a DNA-binding polypeptide that increases the processivity of the DNA polymerase; a tag for ease of tracking and/or purification (e.g., a fluorescent protein, e.g., green fluorescent protein (GFP), yellow fluorescent protein (YFP), red fluorescent protein (RFP), cyan fluorescent protein (CFP), mCherry, tdTomato, and the like; a histidine tag, e.g., a 6×His tag; a hemagglutinin (HA) tag; a FLAG tag; a Myc tag; a flap endonuclease; a DNA ligase; etc.

In some cases, e.g., in the context of a base editor, the additional polypeptide promotes or provides for efficient ligation of the nick generated by the RNA-guided endonuclease after the polymerase makes a mis-incorporation. For example, in some cases, a fusion polypeptide of the present disclosure comprises a flap endonuclease and/or a DNA ligase.

A suitable flap endonuclease comprises an amino acid sequence having at least 85%, at least 90%, at least 95%, at least 98%, at least 99%, or 100%, amino acid sequence identity to the FEN1 amino acid sequence depicted in FIG. 20.

A suitable DNA ligase comprises an amino acid sequence having at least 85%, at least 90%, at least 95%, at least 98%, at least 99%, or 100%, amino acid sequence identity to the T4 DNA ligase amino acid sequence depicted in FIG. 21.

In some cases, a fusion polypeptide of the present disclosure comprises, in order from N-terminus to C-terminus: a) an error-prone DNA polymerase; b) a flap endonuclease; and c) an enzymatically active RNA-guided endonuclease that introduces a single-stranded break in a target DNA. In some cases, a fusion polypeptide of the present disclosure comprises, in order from N-terminus to C-terminus: a) an error-prone DNA polymerase; b) an enzymatically active RNA-guided endonuclease that introduces a single-stranded break in a target DNA; and c) a DNA ligase.

Localization Signals

In some cases, a fusion polypeptide of the present disclosure comprises one or more localization signal peptides. Suitable localization signals ("subcellular localization signals") include, e.g., a nuclear localization signal (NLS) for targeting to the nucleus; a sequence to keep the fusion protein out of the nucleus, e.g., a nuclear export sequence (NES); a sequence to keep the fusion protein retained in the cytoplasm; a mitochondrial localization signal for targeting to the mitochondria; a chloroplast localization signal for targeting to a chloroplast; an endoplasmic reticulum (ER) retention signal; and ER export signal; and the like. In some cases, a fusion polypeptide does not include a NLS so that the protein is not targeted to the nucleus (which can be advantageous, e.g., when the target nucleic acid is an RNA that is present in the cytosol).

In some cases, a fusion polypeptide includes (is fused to) a nuclear localization signal (NLS) (e.g., in some cases 2 or more, 3 or more, 4 or more, or 5 or more NLSs). Thus, in some cases, a fusion polypeptide includes one or more NLSs (e.g., 2 or more, 3 or more, 4 or more, or 5 or more NLSs). In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus.

In some cases, a fusion polypeptide includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases, a fusion polypeptide includes (is fused to) between 2 and 5 NLSs (e.g., 2-4, or 2-3 NLSs).

Non-limiting examples of NLSs include an NLS sequence derived from: the NLS of the SV40 virus large T-antigen, having the amino acid sequence PKKKRKV (SEQ ID NO:1172); the NLS from nucleoplasmin (e.g., the nucleoplasmin bipartite NLS with the sequence KRPAATKKAGQAKKKK (SEQ ID NO:1173)); the c-myc NLS having the amino acid sequence PAAKRVKLD (SEQ ID NO:1174) or RQRRNELKRSP (SEQ ID NO:1175); the hRNPA1 M9 NLS having the sequence NQSSNFGPMKGGNFGGRSSGPYGGGGQYFAKPRNQGGY (SEQ ID NO:1176); the sequence RMRIZFKNKGKDTAELRRRRVEVSVELRKAKKDEQILKRRNV (SEQ ID NO:1177) of the IBB domain from importin-alpha; the sequences VSRKRPRP (SEQ ID NO:1178) and PPKKARED (SEQ ID NO:1179) of the myoma T protein; the sequence PQPKKKPL (SEQ ID NO:1180) of human p53; the sequence SALIKKKKMAP (SEQ ID NO:1181) of mouse c-abl IV; the sequences DRLRR (SEQ ID NO:1182) and PKQKKRK (SEQ ID NO:1183) of the influenza virus NS1; the sequence RKLKKKIKKL (SEQ ID NO:1184) of the Hepatitis virus delta antigen; the sequence REKKKFLKRR (SEQ ID NO:1185) of the mouse Mx1 protein; the sequence KRKGDEVDGVDEVAKKKSKK (SEQ ID NO:1186) of the human poly(ADP-ribose) polymerase; and the sequence RKCLQAGMNLEARKTKK (SEQ ID NO:1187) of the steroid hormone receptors (human) glucocorticoid. In some cases, an NLS comprises the amino acid sequence MDSLL-MNRRKFLYQFKNVRWAKGRRETYLC (SEQ ID NO:1188). In general, NLS (or multiple NLSs) are of sufficient strength to drive accumulation of the fusion polypeptide in a detectable amount in the nucleus of a eukaryotic cell. Detection of accumulation in the nucleus may be performed by any suitable technique. For example, a detectable marker may be fused to the fusion polypeptide such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

In some cases, the NLS is located N-terminal of the RNA-guided endonuclease present in a fusion polypeptide of the present disclosure. In some cases, the NLS is located between the DNA polymerase and the RNA-guided endonuclease present in a fusion polypeptide of the present disclosure. In some cases, the NLS is located N-terminal of the DNA polymerase present in a fusion polypeptide of the present disclosure. In some cases, the NLS is located C-terminal of the DNA polymerase present in a fusion polypeptide of the present disclosure.

In some cases, a fusion polypeptide includes a "Protein Transduction Domain" or PTD (also known as a CPP—cell penetrating peptide), which refers to a polypeptide, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from extracellular space to intracellular space, or cytosol to within an organelle. In some embodiments, a PTD is covalently linked to the amino terminus of a polypeptide. In some embodiments, a PTD is covalently linked to the carboxyl terminus of a polypeptide. In some cases, the PTD is inserted internally in the fusion polypeptide (i.e., is not at the N- or C-terminus of the fusion polypeptide) at a suitable insertion site. In some cases, a subject fusion polypeptide includes (is conjugated to, is fused to) one or more PTDs (e.g., two or more, three or more, four or more PTDs). In some cases, a PTD includes a nuclear localization signal (NLS) (e.g, in some cases 2 or more, 3 or more, 4 or more, or 5 or more NLSs). Thus, in some cases, a fusion polypeptide includes one or more NLSs (e.g., 2 or more, 3 or more, 4 or more, or 5 or more NLSs). In some embodiments, a PTD is covalently linked to a nucleic acid (e.g., a guide nucleic acid, a polynucleotide encoding a guide nucleic acid, a polynucleotide encoding a fusion polypeptide, a donor polynucleotide, etc.). Examples of PTDs include but are not limited to a minimal undecapeptide protein transduction domain (corresponding to residues 47-57 of HIV-1 TAT comprising YGRKKRRQRRR; SEQ ID NO:1189); a polyarginine sequence comprising a number of arginines sufficient to direct entry into a cell (e.g., 3, 4, 5, 6, 7, 8, 9, 10, or 10-50 arginines); a VP22 domain (Zender et al. (2002) Cancer Gene Ther. 9(6):489-96); an Drosophila Antennapedia protein transduction domain (Noguchi et al. (2003) Diabetes 52(7):1732-1737); a truncated human calcitonin peptide (Trehin et al. (2004) Pharm. Research 21:1248-1256); polylysine (Wender et al. (2000) Proc. Natl. Acad. Sci. USA 97:13003-13008); RRQRRTSK-LMKR (SEQ ID NO:1190); Transportan GWTLN-SAGYLLGKINLKALAALAKKIL (SEQ ID NO:1191); KALAWEAKLAKALAKALAKHLAKALAKALKCEA (SEQ ID NO:1192); and RQIKIWFQNRRMKWKK (SEQ ID NO:1193). Exemplary PTDs include but are not limited to, YGRKKRRQRRR (SEQ ID NO:1189), RKKRRQRRR (SEQ ID NO:1194); an arginine homopolymer of from 3 arginine residues to 50 arginine residues; Exemplary PTD domain amino acid sequences include, but are not limited to, any of the following: YGRKKRRQRRR (SEQ ID NO:1189); RKKRRQRR (SEQ ID NO:1195); YARAAAR-QARA (SEQ ID NO:1196); THRLPRRRRRR (SEQ ID NO:1197); and GGRRARRRRRR (SEQ ID NO:1198). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

DNA-Binding Polypeptides that Increase the Processivity of the DNA Polymerase

In some cases, a fusion polypeptide of the present disclosure comprises a DNA-binding polypeptide that increases the processivity of the DNA polymerase. Suitable DNA-binding polypeptides that increase the processivity of the DNA polymerase include, but are not limited to, an Sso7d polypeptide, a helix-hairpin-helix domain of topoisomerase I, a thioredoxin binding domain of a T7 DNA polymerase, or a thioredoxin binding domain of a T3 polymerase.

Suitable Sso7d polypeptides comprise an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Sso7d amino acid sequence depicted in FIG. 12.

Suitable thioredoxin binding domains comprise an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the following amino acid sequence:

(SEQ ID NO: 1199)
TETFGSWYQPKGGTEMFCHPRTGKPLPKYPRIKTPKVGGI

FKKPKNKAQREGREPCELDTREYVAGAPYTPVEHV.

Systems

The present disclosure provides a system comprising: a) a fusion polypeptide of the present disclosure; and b) a guide RNA that comprises: i) a protein-binding segment comprising a nucleotide sequence that binds to the RNA-guided endonuclease; and ii) a target-binding segment comprising a nucleotide sequence that is complementary to a target nucleotide sequence in a target nucleic acid. Fusion polypeptides of the present disclosure are described above. Suitable guide RNAs are described above. A system of the present disclosure (e.g., a system comprising: a) a fusion protein comprising: i) an enzymatically active RNA-guided endonuclease that introduces a single-stranded break in a target DNA; and ii) an error-prone DNA polymerase; and b) a guide RNA) is also referred to herein as "EvolvR."

In some cases, the guide RNA is a single-molecule guide RNA. In some cases, the guide RNA is a dual-molecule guide RNA. In some cases, the guide RNA comprises one or more of: a) a modified base; b) a modified backbone; c) a modified sugar moiety; and d) a non-natural internucleoside linkage. Such modifications are described above.

Nucleic Acids; Recombinant Expression Vectors

The present disclosure provides a nucleic acid comprising a nucleotide sequence encoding a fusion polypeptide of the present disclosure.

In some cases, a nucleic acid comprising a nucleotide sequence encoding a fusion polypeptide of the present disclosure is contained within an expression vector. Thus, the present disclosure provides a recombinant expression vector comprising a nucleic acid comprising a nucleotide sequence encoding a fusion polypeptide of the present disclosure. In some cases, the nucleotide sequence encoding a fusion polypeptide of the present disclosure is operably linked to a transcriptional control element (e.g., a promoter; an enhancer; etc.). In some cases, the transcriptional control element is inducible. In some cases, the transcriptional control element is constitutive. In some cases, the promoters are functional in eukaryotic cells. In some cases, the promoters are cell type-specific promoters. In some cases, the promoters are tissue-specific promoters.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology*, 153:516-544).

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process).

Suitable promoter and enhancer elements are known in the art. For expression in a bacterial cell, suitable promoters include, but are not limited to, lacd, lacZ, T3, T7, gpt, lambda P and trc. For expression in a eukaryotic cell, suitable promoters include, but are not limited to, light and/or heavy chain immunoglobulin gene promoter and enhancer elements; cytomegalovirus immediate early promoter; herpes simplex virus thymidine kinase promoter; early and late SV40 promoters; promoter present in long terminal repeats from a retrovirus; mouse metallothionein-I promoter; and various art-known tissue specific promoters.

Suitable reversible promoters, including reversible inducible promoters are known in the art. Such reversible promoters may be isolated and derived from many organisms, e.g., eukaryotes and prokaryotes. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Inducible promoters suitable for use include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

Examples of constitutive plant promoters include the cauliflower mosaic virus (CaMV) 35S promoter, which confers constitutive, high-level expression in most plant tissues (see, e.g., Odell et al. (1985) Nature 313: 810-812); the nopaline synthase promoter (An et al. (1988) Plant Physiol. 88: 547-552); and the octopine synthase promoter (Fromm et al. (1989) Plant Cell 1: 977-984).

A variety of plant gene promoters that regulate gene expression in response to environmental, hormonal, chemical, developmental signals, and in a tissue-active manner can be used for expression of a nucleotide sequence (e.g., a nucleotide sequence encoding a fusion polypeptide of the present disclosure) in plants. The choice of a promoter can be determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) Plant Mol. Biol. 11: 651-662), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) Plant Mol. Biol. 37: 977-988), flower-specific (Kaiser et al. (1995) Plant Mol. Biol. 28: 231-243), pollen (Baerson et al. (1994) Plant Mol. Biol. 26: 1947-1959), carpels (Ohl et al. (1990) Plant Cell 2: 837-848), pollen and ovules (Baerson et al. (1993) Plant Mol. Biol. 22: 255-267), auxin-inducible promoters (such as that described in van der Kop et al. (1999) Plant Mol. Biol. 39: 979-990 or Baumann et al. (1999) Plant Cell 11: 323-334), cytokinin-inducible promoter (Guevara-Garcia (1998) Plant Mol. Biol. 38: 743-753), promoters responsive to gibberellin (Shi et al. (1998) Plant Mol. Biol. 38: 1053-1060, Willmott et al. (1998) 38: 817-825) and the like. Additional promoters are those that elicit expression in response to heat (Ainley et al. (1993) Plant Mol. Biol. 22: 13-23), light (e.g., the pea rbcS-3A promoter, Kuhlemeier et al. (1989) Plant Cell 1: 471-478, and the maize rbcS promoter, Schaffner and Sheen (1991) Plant Cell 3: 997-1012); wounding (e.g., wunI, Siebertz et al. (1989) Plant Cell 1: 961-968); pathogens (such as the PR-1 promoter described in Buchel et al. (1999) Plant Mol. Biol. 40: 387-396, and the PDF1.2 promoter described in Manners et al. (1998) Plant Mol. Biol. 38: 1071-1080), and chemicals such as methyl jasmonate or salicylic acid (Gatz (1997) Annu. Rev. Plant Physiol. Plant Mol. Biol. 48: 89-108). In addition, the timing of the expression can be controlled by using promoters such as those acting at senescence (Gan and Amasino (1995) Science 270: 1986-1988); or late seed development (Odell et al. (1994) Plant Physiol. 106: 447-458).

In some cases, a nucleic acid comprising a nucleotide sequence encoding a fusion polypeptide of the present disclosure is a recombinant expression vector. In some embodiments, the recombinant expression vector is a viral construct, e.g., a recombinant adeno-associated virus (AAV) construct, a recombinant adenoviral construct, a recombinant lentiviral construct, a recombinant retroviral construct, etc. In some cases, a nucleic acid comprising a nucleotide sequence encoding a fusion polypeptide of the present disclosure is a recombinant lentivirus vector. In some cases, a nucleic acid comprising a nucleotide sequence encoding a fusion polypeptide of the present disclosure is a recombinant AAV vector.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., Hum Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like. In some cases, the vector is a lentivirus vector. Also suitable are transposon-mediated vectors, such as piggyback and sleeping beauty vectors.

A number of expression vectors suitable for stable transformation of plant cells or for the establishment of transgenic plants have been described including those described in Weissbach and Weissbach (1989) Methods for Plant Molecular Biology, Academic Press, and Gelvin et al. (1990) Plant Molecular Biology Manual, Kluwer Academic Publishers. Specific examples include those derived from a Ti plasmid of *Agrobacterium tumefaciens*, as well as those disclosed by Herrera-Estrella et al. (1983) Nature 303: 209, Bevan (1984) Nucleic Acids Res. 12: 8711-8721, Klee (1985) Bio/Technology 3: 637-642, for dicotyledonous plants.

Alternatively, non-Ti vectors can be used to transfer a nucleic acid into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) Bio/Technology 9: 957-962) and corn (Gordon-Kamm (1990) Plant Cell 2: 603-618) can be produced. An immature embryo can also be a good target tissue for monocots for direct DNA delivery techniques by using the particle gun (Weeks et al. (1993) Plant Physiol. 102: 1077-1084; Vasil (1993) Bio/Technology 10: 667-674; Wan and Lemeaux (1994) Plant Physiol. 104: 37-48, and for *Agrobacterium*-mediated DNA transfer (Ishida et al. (1996) Nature Biotechnol. 14: 745-750).

Cells

The present disclosure provides a cell comprising a fusion polypeptide of the present disclosure. The present disclosure provides a cell comprising a system of the present disclosure. The present disclosure provides a cell comprising a nucleic acid (e.g., a recombinant expression vector) of the present disclosure.

Suitable host cells include, e.g. a bacterial cell; an archaeal cell; a cell of a single-cell eukaryotic organism; a plant cell; an algal cell, e.g., *Botryococcus braunii, Chlamydomonas reinhardtii, Nannochloropsis gaditana, Chlorella pyrenoidosa, Sargassum patens*, C. Agardh, and the like; a fungal cell (e.g., a yeast cell); an animal cell; a cell from an invertebrate animal (e.g. fruit fly, cnidarian, echinoderm, nematode, etc.); a cell from a vertebrate animal (e.g., fish, amphibian, reptile, bird, mammal); a cell from a mammal (e.g., a cell from a rodent, a cell from a human, etc.); and the like.

A suitable host cell can be a stem cell (e.g. an embryonic stem (ES) cell, an induced pluripotent stem (iPS) cell); a germ cell; a somatic cell, e.g. a fibroblast, a hematopoietic cell, a neuron, a muscle cell, a bone cell, a hepatocyte, a pancreatic cell; an in vitro or in vivo embryonic cell of an embryo at any stage, e.g., a 1-cell, 2-cell, 4-cell, 8-cell, etc. stage zebrafish embryo; etc.). Cells may be from established cell lines or they may be primary cells, where "primary cells", "primary cell lines", and "primary cultures" are used interchangeably herein to refer to cells and cells cultures that have been derived from a subject and allowed to grow in vitro for a limited number of passages of the culture. For example, primary cultures include cultures that may have been passaged 0 times, 1 time, 2 times, 4 times, 5 times, 10 times, or 15 times, but not enough times go through the crisis stage. Primary cell lines can be maintained for fewer than 10 passages in vitro. Host cells are in some cases unicellular organisms, or are grown in culture.

If the cells are primary cells, they may be harvest from an organism (e.g., an individual) by any convenient method. For example, leukocytes may be conveniently harvested by apheresis, leukocytapheresis, density gradient separation, etc., while cells from tissues such as skin, muscle, bone marrow, spleen, liver, pancreas, lung, intestine, stomach, etc. are most conveniently harvested by biopsy. An appropriate solution may be used for dispersion or suspension of the harvested cells. Such solution will generally be a balanced salt solution, e.g. normal saline, phosphate-buffered saline (PBS), Hank's balanced salt solution, etc., conveniently supplemented with fetal calf serum or other naturally occurring factors, in conjunction with an acceptable buffer at low concentration, e.g., from 5-25 mM. Convenient buffers include HEPES, phosphate buffers, lactate buffers, etc. The cells may be used immediately, or they may be stored, frozen, for long periods of time, being thawed and capable of being reused. In such cases, the cells can be frozen in 10% dimethyl sulfoxide (DMSO), 50% serum, 40% buffered medium, or some other such solution as is commonly used in the art to preserve cells at such freezing temperatures, and thawed in a manner as commonly known in the art for thawing frozen cultured cells.

In some cases, a subject genetically modified host cell is in vitro. In some embodiments, a subject genetically modified host cell is in vivo. In some embodiments, a subject genetically modified host cell is a prokaryotic cell or is derived from a prokaryotic cell. In some embodiments, a subject genetically modified host cell is a bacterial cell or is derived from a bacterial cell. In some cases, a subject genetically modified host cell is an archaeal cell or is derived from an archaeal cell. In some embodiments, a subject genetically modified host cell is a eukaryotic cell or is derived from a eukaryotic cell. In some cases, a subject genetically modified host cell is a plant cell or is derived from a plant cell. In some cases, a subject genetically modified host cell is an animal cell or is derived from an animal cell. In some embodiments, a subject genetically modified host cell is an invertebrate cell or is derived from an invertebrate cell. In some cases, a subject genetically modified host cell is a vertebrate cell or is derived from a vertebrate cell. In some cases, a subject genetically modified host cell is a mammalian cell or is derived from a mammalian cell. In some cases, a subject genetically modified host cell is a rodent cell or is derived from a rodent cell. In cases embodiments, a subject genetically modified host cell is a human cell or is derived from a human cell.

The present disclosure provides a genetically modified plant cell, where the genetically modified plant cell is genetically modified with a nucleic acid (e.g., a recombinant expression vector) comprising a nucleotide sequence encoding a fusion polypeptide of the present disclosure. In some cases, the plant cell is a cell of a monocot (a monocotyledon). In some cases, the plant cell is a cell of a dicot (a dicotyledon). A plant cell can be a cell of the xylem, the phloem, the cambium layer, a leaf, a root, etc.

Suitable plants include, e.g., soybean, wheat, corn, potato, cotton, rice, oilseed rape, sunflower, alfalfa, clover, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, mint and other labiates, rosaceous fruits, and vegetable brassicas.

Plant protoplasts are also suitable for some applications. For example, a nucleic acid is introduced into plant tissues, cultured plant cells or plant protoplasts by standard methods including electroporation (Fromm et al. (1985) Proc. Natl. Acad. Sci. 82: 5824-5828), infection by viral vectors such as cauliflower mosaic virus (CaMV) (Hohn et al. (1982) Molecular Biology of Plant Tumors Academic Press, New York, N.Y., pp. 549-560; U.S. Pat. No. 4,407,956), high velocity ballistic penetration by small particles with the nucleic acid either within the matrix of small beads or particles, or on the surface (Klein et al. (1987) Nature 327: 70-73), use of pollen as vector (WO 85/01856), or use of *Agrobacterium tumefaciens* or *A. rhizogenes* carrying a T-DNA plasmid in which a nucleic acid encoding a fusion polypeptide of the present disclosure is cloned. The T-DNA plasmid is transmitted to plant cells upon infection by *Agrobacterium tumefaciens*, and a portion is stably integrated into the plant genome (Horsch et al. (1984) Science 233: 496-498; Fraley et al. (1983) Proc. Natl. Acad. Sci. 80: 4803-4807).

The present disclosure further provides progeny of a subject genetically modified cell, where the progeny can comprise the same exogenous nucleic acid or polypeptide as the subject genetically modified cell from which it was derived. The present disclosure further provides a composition comprising a subject genetically modified host cell.

Methods

A fusion polypeptide of the present disclosure is useful for introducing mutations into a target region of a target nucleic acid; i.e., in some cases, a fusion polypeptide of the present disclosure functions as a mutator. Thus, the present disclosure provides methods of introducing mutations into a target region of a target nucleic acid. A fusion polypeptide of the present disclosure is useful for correcting a mutation in a target nucleic acid; i.e., in some cases, a fusion polypeptide of the present disclosure functions as a base editor. Thus, the present disclosure provides methods correcting a mutation in a target nucleic acid.

Method of Introducing Mutations into a Target Region of a Target Nucleic Acid

The present disclosure provides a method of mutagenizing a target nucleic, e.g., introducing mutations into a target nucleic acid. The method comprises contacting the target nucleic acid with a system of the present disclosure (e.g., EvolvR); i.e., the method comprises contacting the target nucleic acid with a complex comprising: a) a fusion polypeptide of the present disclosure; and b) a guide RNA. In some cases, the target nucleic acid is present in a cell; and the method comprises introducing a system of the present disclosure into the cell. In some cases, the cell is a prokaryotic cell. In some cases, the cell is a eukaryotic cell. In some cases, the cell is a plant cell. In some cases, the plant cell is a cell of a dicotyledonous plant. In some cases, the plant cell is a cell of a monocotyledonous plant. In some cases, the cell is in vitro. In some cases, the cell is in vivo.

A method of the present disclosure finds use in a variety of applications. Non-limiting examples of applications involving use of an EvolvR system of the present disclosure include: a) diversifying antibody-encoding genes; b) diversifying protein-coding nucleotide sequences; c) diversifying regulatory elements; d) optimizing antibody affinity; e) diversifying T cells; f) engineering T-cell activity; g) discovering disease-causing genotypes; h) engineering desirable traits into plants.

In some cases, contacting a target nucleic acid with a complex comprising: a) a fusion polypeptide of the present disclosure; and b) a guide RNA results in introduction of from 1 mutation to 103 mutations within a target region of a target nucleic acid. For example, in some cases, contacting a target nucleic acid with a complex comprising: a) a fusion polypeptide of the present disclosure; and b) a guide RNA results in introduction of from 1 mutation to 5 mutations, from 5 mutations to 10 mutations, from 10 mutations to 50 mutations, from 50 mutations to $10^2$ mutations, from $10^2$ mutations to $5\times10^2$ mutations, or from to $5\times10^2$ mutations to 103 mutations within a target region of a target nucleic acid. As noted above, in some cases, the target region of a target nucleic acid is from 1 nucleotide (nt) to 10 nucleotides (nt), from 10 nt to 50 nt, from 50 nt to 100 nt, from 100 nt to 500 nt, from 500 nt to $10^3$ nt, from $10^3$ nt to $5\times10^3$ nt, or from $5\times10^3$ nt to $10^4$ nt from a nick in a target DNA introduced by the RNA-guided endonuclease.

Introducing mutations into a target region of a target nucleic acid provides for generation of a plurality of mutants, which can then be selected for a particular desired trait. Alternatively, an undesirable trait can be selected against. A desired trait can be selected for simultaneously with selecting against an undesired trait.

In some cases, a method of the present disclosure comprises: a) mutagenizing a target nucleic acid, generating a plurality of mutated nucleic acids; and b) applying a selection to the mutated nucleic acids. Applying a selection to the mutated nucleic acids can comprise: i) selecting a mutated nucleic acid(s) that confers a desirable trait (phenotype) on a genetically modified host cell comprising the mutated nucleic acid; or ii) selecting a mutated nucleic acid(s) that confers a desirable trait (phenotype) on a transgenic non-human organism that is genetically modified to comprise the mutated nucleic acid. Selection methods are well known in the art, and any known method can be applied.

For example, in some cases, a mutated nucleic acid may confer increased drought resistance to a plant; and the mutated nucleic acid is identified by subjecting a plurality of plants (or a plurality of plant seeds), each of which is genetically modified with a single member of the plurality of mutated nucleic acids, to drought conditions, and selecting plants that exhibit increased resistance to the drought conditions. Drought assays can be applied to identify a mutated nucleic acid that confers better plant survival after short-term, severe water deprivation. Ion leakage can be measured in the context of a drought assay.

As another example, in some cases, a mutated nucleic acid may confer increased resistance of a plant to a pathogen (e.g., a fungus; an insect; etc.); and the mutated nucleic acid is identified by subjecting a plurality of plants (or a plurality of plant seeds), each of which is genetically modified with a single member of the plurality of mutated nucleic acids, to the pathogen, and selecting plants that exhibit increased resistance to the pathogen.

As another example, in some cases, a mutated nucleic acid may confer increased resistance of a plant to salt stress (e.g., high salt conditions; e.g., high NaCl concentrations); and the mutated nucleic acid is identified by subjecting a plurality of plants (or a plurality of plant seeds), each of which is genetically modified with a single member of the plurality of mutated nucleic acids, to high salt conditions, and selecting plants that exhibit increased resistance to the high salt conditions. Plants differ in their tolerance to NaCl depending on their stage of development; therefore seed germination, seedling vigor, and plant growth responses can be evaluated to determine resistance to high salt conditions.

As another example, in some cases, a mutated nucleic acid may confer increased resistance of a plant to freezing; and the mutated nucleic acid is identified by subjecting a plurality of plants (or a plurality of plant seeds), each of which is genetically modified with a single member of the plurality of mutated nucleic acids, to low temperature (e.g., freezing) conditions, and selecting plants that exhibit increased resistance to the low temperature conditions.

As another example, in some cases, a mutated nucleic acid may confer increased ability to germinate under high temperature conditions; and the mutated nucleic acid is identified by subjecting a plurality of plants (or a plurality of plant seeds), each of which is genetically modified with a single member of the plurality of mutated nucleic acids, to high temperature conditions, and selecting plants that exhibit increased resistance to the high temperature conditions. Parameters that can be tested include seed germination, seedling vigor, and plant growth.

As another example, in some cases, a mutated nucleic acid may confer increased resistance to hyperosmotic stress; and the mutated nucleic acid is identified by subjecting a plurality of plants (or a plurality of plant seeds), each of which is genetically modified with a single member of the plurality of mutated nucleic acids, to hyperosmotic stress conditions, and selecting plants that exhibit increased resistance to the hyperosmotic stress conditions. Plants that are resistant to hyperosmotic stress may be more tolerant to drought or freezing.

Sugar sensing assays can be conducted to identify mutated nucleic acids that provide for sugar sensing by germinating seeds on high concentrations of sucrose and glucose and looking for degrees of hypocotyl elongation. The germination assay on mannitol controls for responses related to hyperosmotic stress. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has also been described in plants and is implicated in cell division and repression of "famine" genes (photosynthetic or glyoxylate cycles).

Crop productivity is in part limited by its rate of $CO_2$ fixation by the RuBisCo enzyme. In some cases, all RuBisCo catalytic subunits are simultaneously targeted within cyanobacteria using a system of the present disclosure; growing this microbe under high temperature and/or low $CO_2$ conditions will enrich for RuBisco variants with improved catalytic efficiency and specificity.

Base Editor

In some cases, a system of the present disclosure (a fusion polypeptide of the present disclosure and a guide RNA) is a base editor system that comprises a non-processive DNA polymerase that is biased in which mismatches it generates. Such as system provides for targeted base substitutions.

In some cases, a base editor system of the present disclosure provides for generation of a G→T substitution. In some cases, a base editor system of the present disclosure provides for generation of a G→C substitution. In some cases, a base editor system of the present disclosure provides for generation of a C→A substitution. In some cases, a base editor system of the present disclosure provides for generation of a C→G substitution. In some cases, a base editor system of the present disclosure provides for generation of an A→T substitution. In some cases, a base editor system of the present disclosure provides for generation of an A→G substitution. In some cases, a base editor system of the present disclosure provides for generation of an A→C substitution. In some cases, a base editor system of the present disclosure provides for generation of a T→A substitution. In some cases, a base editor system of the present disclosure provides for generation of a T→G substitution. In some cases, a base editor system of the present disclosure provides for generation of a T→C substitution. In some cases, a base editor system of the present disclosure provides for generation of a G→A substitution. In some cases, a base editor system of the present disclosure provides for generation of a C→T substitution.

A base-editor system of the present disclosure provides for generation of targeted substitutions that can reverse pathogenic single nucleotide polymorphisms. A base-editor system of the present disclosure provides for creation of crop plants with new alleles.

In some cases, the substitution rate is 1 mutation per nucleotide per generation.

A base editor system of the present disclosure comprises a DNA polymerase such as DNA polymerase beta, DNA polymerase iota, DNA polymerase nu, DNA polymerase eta, or DNA polymerase kappa. Variants of these polymerases that place the wrong nucleotide three times more often across from the template base than the correct complementary base can be used.

In some cases, a fusion polypeptide of the present disclosure comprises: a) an enzymatically active RNA-guided endonuclease; and b) a DNA polymerase selected from a DNA polymerase-beta, a DNA polymerase-iota, a DNA polymerase nu, a DNA polymerase eta, and a DNA polymerase kappa.

In some cases, a DNA polymerase beta suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase R having the following amino acid sequence:

```
                                    (SEQ ID NO: 1163)
MSKRKAPQETLNGGITDMLTELANFEKNVSQAIHKYNAYR

KAASVIAKYPHKIKSGAEAKKLPGVGTKIAEKIDEFLATG

KLRKLEKIRQDDTSSSINFLTRVSGIGPSAARKFVDEGIK

TLEDLRKNEDKLNHHQRIGLKYFGDFEKRIPREEMLQMQD

IVLNEVKKVDSEYIATVCGSFRRGAESSGDMDVLLTHPSF

TSESTKQPKLLHQVVEQLQKVHFITDTLSKGETKFMGVCQ

LPSKNDEKEYPHRRIDIRLIPKDQYYCGVLYFTGSDIFNK

NMRAHALEKGFTINEYTIRPLGVTGVAGEPLPVDSEKDIF

DYIQWKYREPKDRSE.
```

In some cases, a DNA polymerase iota suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase iota having the following amino acid sequence: MEKLGVEPEEEGGGDDDEEDAEAWAMELADVGAAASSQGVHDQVLPTPNASSRVIVH VDLDCFYAQVEMISNPELKDKPLGVQQKYLVVTCNYEARKLGVKKLMNVRDAKEKCP QLVLVNGEDLTRYREMSYKVTELLEEFSPVVERLGFDENFVDLTEMVEKRLQQLQSDE LSAVTVSGHVYNNQSINLLDVLHIRLLVGSQIAAEMREAMYNQLGLTGCAGVASNKLL AKLVSGVFKPNQQTVLLPESCQHLIHSLNHIKEIPGIGYKTAKCLEALGINSVRDLQTFSP KILEKELGISVAQRIQKLSFGEDNSPVILSGPPQSFSEEDSFKKCSSEVEAKNKIEELLASLL NRVCQDGRKPHTVRLIIRRYSSEKHYGRESRQCPIPSHVIQKLGTGNYDVMTPMVDILM KLFRNMVNVKMPFHLTLLSVCFCNLKALNTAKKGLIDYYLMPSLSTTSRSGKHSFKMK DTHMEDFPKDKETNRDFLPSGRIESTRTRESPLDTTNFSKEKDINEFPLCSLPEGVDQEVF KQLPVDIQEEILSGKSREKFQGKGSVSCPLHASRGVLSFFSKKQMQDIPINPRDHLSSSKQ VSSVSPCEPGTSGFNSSSSSYMSSQKDYSYYLDNRLKDERISQGPKEPQGFHFTNSNPAV SAFHSFPNLQSEQLFSRNHTTDSHKQTVATDSHEGLTENREPDSVDEKITFPSDIDPQVFY ELPEAVQKELLAEWKRAGSDFHIGHK (SEQ ID NO:1164). In some cases, such a DNA polymerase generates T→G substitutions.

In some cases, a DNA polymerase iota suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase iota having the following amino acid sequence (amino acids 1-445 of DNA polymerase iota): MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCP QLVLVNGEDLTRYREMSYKVTELLEEFSPVVERLGFDENFVDLTEMVEKRLQQLQSDE LSAVTVSGHVYNNQSINLLDVLHIRLLVGSQIAAEMREAMYNQLGLTGCAGVASNKLL AKLVSGVFKPN- QQTVLLPESCQHLIHSLNHIKEIPGIGYKTAKCLEALGINSVRDLQTFSP KILEKELGISVAQRIQKLSFGEDN- SPVILSGPPQSFSEEDSFKKCSSEVEAKNKIEELLASLL NRVCQDGRKPHTVRLIIRRYSSEKHYGRESRQCPIPSHVIQKLGTGNYDVMTPMVDILM KLFRNMVNVKMPFHLTLLSVCFCNLKALNTAK (SEQ ID NO:1165); and having a length of 445 amino acids. In some cases, such a DNA polymerase generates T→G substitutions. In some cases, such a DNA polymerase has a T→G error rate approaching 1.

In some cases, a DNA polymerase iota suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase iota having the following amino acid sequence (amino acids 26-445 of DNA polymerase iota): ELADVGAAASSQGVHDQVLPTPNASSRVIVHVDLDCFYAQVEMISNPELKDKPLGVQQ KYLVVTCNYEARKLGVKKLMNVRDAKEKCPQLVLVNGEDLTRYREMSYKVTELLEEF SPVVERLGFDENFVDLTEMVEKRLQQLQSDELSAVTVSGHVYNNQSINLLDVLHIRLLV GSQIAAEMREAMYNQLGLTGCAGVASNKLLAKLVSGVFKPNQ- QTVLLPESCQHLIHSL NHIKEIPGIGYKTAKCLEALGINSVRDLQTFSPKILEKELGISVAQRIQKLSFGEDNSPVILS GPPQSFSEEDSFKKCSSEVEAKNKIEELLASLLNRVCQDGRKPHTVRLIIRRYSSEKHYGR ESRQCPIPSHVIQKLGTGNYDVMTPMVDILMKLFRNMVNVKMPFHLTLLSVCFCNLKA LNTAK (SEQ ID NO:1166); and having a length of 419 amino acids. In some cases, such a DNA polymerase generates T→G substitutions. In some cases, such a DNA polymerase has a T→G error rate approaching 1.

In some cases, a DNA polymerase iota suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase nu (v) having the following amino acid sequence: ENYEALVGFDLCNTPLSSVAQKIMSAMHSGDLVDSKTWGKSTETMEVINKSSVKYSVQ LEDRKTQS- PEKKDLKSLRSQTSRGSAKLSPQSFSVRLTDQLSAD-
QKQKSISSLTLSSCLIP QYNQEASVLQKKG- HKRKH-
FLMENINNENKGSINLKRKHITYNNLSEKTSKQMA-
LEEDTDDAEGYLNSGNSGALKKHFCDIRHLDDWA-
KSQLIEMLKQAAALVITVMYTDGSTQLGADQTPV-
SSVRGIVVLVKRQAEGGHGCPDAPACGPVLEGFV-
SDDPCIYIQIEHSAIWDQEQEAHQQFARNVLFQTM-
KCKCPVICFNAKDFVRIVLQFFGNDGSWKHVAD-
FIGLDPRIAAWLIDPSDATPSFEDLVEKYCEKSITVK-
VNSTYGNSSRNIVNQNVRENLKTLYRLTMDLCSKL-
KDYGLWQLFRTLELPLIPILAVMESHAIQVNKEEME-
KTSALLGARLKELEQEAHFVA GERFLITSNNQLREIL-
FGKLKLHLLSQRNSLPRTGLQKYPSTSEAVLNALR-
DLHPLPKIILE YRQVHKIKSTFVDGLLACMKKGSIS-
STWNQTGTVTGRLSAKHPNIQGISKHPIQITTPKN
FKGKEDKILTISPRAMFVSSKGHTFLAADFSQIEL-
RILTHLSGDPELLKLFQESERDDVFST LTSQWKDVP-
VEQVTHADREQTKKVVYAVVYGAGKERLAACLG-
VPIQEAAQFLESFLQKYKKIKDFARAAIAQCHQTG-
CVVSIMGRRRPLPRIHAHDQQLRAQAERQAVNFV-
VQGS AADLCKLAMIHVFTAVAASHTLTARLVAQIHD-
ELLFEVEDPQIPECAALVRRTMESLEQVQALELQLQ-
VPLKVSLSAGRSWGHLVPLQEAWGPPPGPCRTESP-
SNSLAAPGSPASTQP PPLHFSPSFCL (SEQ ID NO:
1167). In some cases, such a DNA polymerase generates
G→T substitutions.

In some cases, a DNA polymerase eta suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase eta (η) having the following amino acid sequence:

```
                                    (SEQ ID NO: 1168)
MATGQDRVVALVDMDCFFVQVEQRQNPHLRNKPCAVVQYK

SWKGGGIIAVSYEARAFGVTRSMWADDAKKLCPDLLLAQV

RESRGKANLTKYREASVEVMEIMSRFAVIERASIDEAYVD

LTSAVQERLQKLQGQPISADLLPSTYIEGLPQGPTTAEET

VQKEGMRKQGLFQWLDSLQIDNLTSPDLQLTVGAVIVEEM

RAAIERETGFQCSAGISHNKVLAKLACGLNKPNRQTLVSH

GSVPQLFSQMPIRKIRSLGGKLGASVIEILGIEYMGELTQ

FTESQLQSHFGEKNGSWLYAMCRGIEHDPVKPRQLPKTIG

CSKNFPGKTALATREQVQWWLLQLAQELEERLTKDRNDND

RVATQLVVSIRVQGDKRLSSLRRCCALTRYDAHKMSHDAF

TVIKNCNTSGIQTEWSPPLTMLFLCATKFSASAPSSSTDI

TSFLSSDPSSLPKVPVTSSEAKTQGSGPAVTATKKATTSL

ESFFQKAAERQKVKEASLSSLTAPTQAPMSNSPSKPSLPF

QTSQSTGTEPFFKQKSLLLKQKQLNNSSVSSPQQNPWSNC

KALPNSLPTEYPGCVPVCEGVSKLEESSKATPAEMDLAHN

SQSMHASSASKSVLEVTQKATPNPSLLAAEDQVPCEKCGS

LVPVWDMPEHMDYHFALELQKSFLQPHSSNPQVVSAVSHQ

GKRNPKSPLACTNKRPRPEGMQTLESFFKPLTH.
```

In some cases, a DNA polymerase eta suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase eta (η) having the following amino acid sequence: MATGQDRV-
VALVDMDCFFVQVEQRQNPHLRNKPCAVVQYKSW-
KGGGIIAVSYEARAFGVTRSMWADDAKKLCPDLL-
LAQVRESRGKANLTKYREASVEVMEIMSRFAVIERA-
SIDEAYVDLTSAVQERLQKLQGQPISADLLPSTY-IE-
GLPQGPTTAEETVQKEGMRKQGLFQWLDSLQIDN-
LTSPDLQLTVGAVIVEEMRAAIERETGFQCSAGISH-
NKVLAKLACGLNKPNRQTLVSHGSVPQLFSQMPI-
RKIRSLGGKLGASVIEILGIEYMGELTQFTESQLQS-
HFGEKNGSWLYAMCRGIEHDPVKPRQLPKTIGCS-
KNFPGKTALATREQVQWWLLQLAQELEERLT KDR-
NDNDRVATQLVVSIRVQGDKRLSSLRRCCALTRYD-
AHKMSHDAFTVIKNCNTSGI QTEWSPPLTMLFLCA-
TKFSASAPSSSTDITSFLSSDPSSLPKVPVTSSEAKTQ-
GSGPAVTA TKKATTSLESFFQKAAERQKVKEASLSS-
LTAPTQAPMSN (SEQ ID NO:1169); and has a length of 511 amino acids.

In some cases, a DNA polymerase kappa suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase kappa (κ) having the following amino acid sequence:

```
                                    (SEQ ID NO: 1170)
MDSTKEKCDSYKDDLLLRMGLNDNKAGMEGLDKEKINKII

MEATKGSRFYGNELKKEKQVNQRIENMMQQKAQITSQQLR

KAQLQVDRFAMELEQSRNLSNTIVHIDMDAFYAAVEMRDN

PELKDKPIAVGSMSMLSTSNYHARRFGVRAAMPGFIAKRL

CPQLIIVPPNFDKYRAVSKEVKEILADYDPNFMAMSLDEA

YLNITKHLEERQNWPEDKRRYFIKMGSSVENDNPGKEVNK

LSEHERSISPLLFEESPSDVQPPGDPFQVNFEEQNNPQIL

QNSVVFGTSAQEVVKEIRFRIEQKTTLTASAGIAPNTMLA

KVCSDKNKPNGQYQILPNRQAVMDFIKDLPIRKVSGIGKV

TEKMLKALGIITCTELYQQRALLSLLFSETSWHYFLHISL

GLGSTHLTRDGERKSMSVERTFSEINKAEEQYSLCQELCS

ELAQDLQKERLKGRTVTIKLKNVNFEVKTRASTVSSVVST

AEEIFAIAKELLKTEIDADFPHPLRLRLMGVRISSFPNEE

DRKHQQRSIIGFLQAGNQALSATECTLEKTDKDKFVKPLE

MSHKKSFFDKKRSERKWSHQDTFKCEAVNKQSFQTSQPFQ

VLKKKMNENLEISENSDDCQILTCPVCFRAQGCISLEALN
```

-continued

KHVDECLDGPSISENFKMFSCSHVSATKVNKKENVPASSL

CEKQDYEAHPKIKEISSVDCIALVDTIDNSSKAESIDALS

NKHSKEECSSLPSKSFNIEHCHQNSSSTVSLENEDVGSFR

QEYRQPYLCEVKTGQALVCPVCNVEQKTSDLTLFNVHVDV

CLNKSFIQELRKDKFNPVNQPKESSRSTGSSSGVQKAVTR

TKRPGLMTKYSTSKKIKPNNPKHTLDIFFK.

In some cases, a DNA polymerase kappa suitable for inclusion in a fusion polypeptide of the present disclosure comprises an amino acid sequence having at least 85%, at least 90%, at least 95%, at least 98%, at least 99%, or 100%, amino acid sequence identity to a DNA polymerase kappa (κ) having the following amino acid sequence: MDSTKEKCDSYKDDLLLRMGLNDNKAGMEGLDKEKIN-KIIMEATKGSRFYGNELKKEKQVNQRIENMMQQ-KAQITSQQLRKAQLQVDRFAMELEQSRNLSNTIV-HIDMDAFYAAVEMRDNPELKDKPIAVGSMSMLST-SNYHARRFGVRAAMPGFIAKRLCPQLIIVPPNFDKY RAVSKEVKEILADYDPNFMAMSLDEAYLNITKH-LEERQNWPEDKRRYFIKMGSSVENDNPGKEVNK-LSEHERSISPLLFEESPSDVQPPGDPFQVNFEEQNN-PQILQNSVVFGTSAQEVVKEIRFRIEQKTTLTASAG-IAPNTMLAKVCSDKNKPNGQYQILPNRQAVMDFI-KDLPIRK VSGIGKVTEKMLKALGIITCTELYQQRA-LLSLLFSETSWHYFLHISLGLGSTHLTRDGER KSMS-VERTFSEINKAEEQYSLCQELCSELAQDLQKERLKG-RTVTIKLKNVNFEVKTRAST VSSVVSTAEEIFAIAKE-LLKTEIDADFPHPLRLRLMGVRISSFPNEEDRKHQQR-SIIGFLQA GNQALSATECTLEKTDKDKFVKPLE (SEQ ID NO:1171); and has a length of 560 amino acids.

In some cases, a base editor system of the present disclosure comprises: a) a fusion polypeptide of the present disclosure (e.g., a fusion polypeptide comprising: i) an enzymatically active RNA-guided endonuclease; and ii) a DNA polymerase selected from a DNA polymerase-beta, a DNA polymerase-iota, a DNA polymerase nu, a DNA polymerase eta, and a DNA polymerase kappa); and b) a guide RNA that comprises a nucleotide sequence that comprises: i) a protein-binding segment comprising a nucleotide sequence that binds to the RNA-guided endonuclease; and ii) a target-binding segment comprising a nucleotide sequence that is complementary to a target nucleotide sequence in a target nucleic acid.

In some cases, a base editor system of the present disclosure comprises: a) a nucleic acid (e.g., a recombinant expression vector) comprising a nucleotide sequence encoding a fusion polypeptide of the present disclosure (e.g., a fusion polypeptide comprising: i) an enzymatically active RNA-guided endonuclease; and ii) a DNA polymerase selected from a DNA polymerase-beta, a DNA polymerase-iota, a DNA polymerase nu, a DNA polymerase eta, and a DNA polymerase kappa); and b) a guide RNA that comprises a nucleotide sequence that comprises: i) a protein-binding segment comprising a nucleotide sequence that binds to the RNA-guided endonuclease; and ii) a target-binding segment comprising a nucleotide sequence that is complementary to a target nucleotide sequence in a target nucleic acid.

A fusion polypeptide of the present disclosure is useful for correcting a mutation in a target nucleic acid; i.e., in some cases, a fusion polypeptide of the present disclosure functions as a base editor. Thus, the present disclosure provides methods correcting a mutation in a target nucleic acid.

In some cases, the target nucleic acid comprises a target nucleotide sequence associated with a disease or disorder. In some cases, the target nucleotide sequence comprises a point mutation associated with a disease or disorder. In some cases, a base editor system of the present disclosure introduces a single nucleotide mutation; i.e., changes a single nucleotide in a target nucleotide sequence.

In some cases, the disease or disorder is cystic fibrosis; phenylketonuria; epidermolytic hyperkeratosis (EHK); Charcot-Marie-Toot disease type 4J; neuroblastoma (NB); von Willebrand disease (vWD); myotonia congenital; hereditary renal amyloidosis; dilated cardiomyopathy (DCM); hereditary lymphedema; familial Alzheimer's disease; Prion disease; chronic infantile neurologic cutaneous particular syndrome (CINCA); desmin-related myopathy (DRM); or a neoplastic disease associated with a mutant PI3KCA protein, a mutant CTNNB1 protein, a mutant HRAS protein, or a mutant p53 protein.

A base editor system of the present disclosure is introduced into a cell (in vivo or in vitro), where the cell comprises a target nucleic acid comprising a target nucleotide sequence having a single nucleotide mutation that gives rise to a disease or disorder. For example, a eukaryotic cell comprising a mutation to be corrected, e.g., a cell carrying a point mutation, is contacted with a base editor system of the present disclosure. Suitable cells include mammalian cells, including, e.g., non-human primate cells, human cells, canine cells, feline cells, ungulate cells, etc. Suitable cells include plant cells. Suitable cells include insect cells. Suitable cells include arachnid cells.

A base editor system of the present disclosure is capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some cases, it is desirable to generate base editors that efficiently substitute a specific nucleotide within a nucleic acid, without generating a large number of insertions or deletions (i.e., indels) in the nucleic acid. In cases, a base editor system of the present disclosure is capable of generating a greater proportion of intended modifications (e.g., nucleotide substitutions) versus indels. In some cases, a base editor system of the present disclosure is capable of generating a ratio of intended point mutations to indels that is greater than 1:1. In some cases, a base editor system of the present disclosure is capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more than 1000:1.

Fusion Polypeptide Comprising a Modifying Enzyme, an RNA-Guided Nickase, and a DNA Polymerase The present disclosure provides a fusion polypeptide comprising: a) an RNA-guided enzyme that exhibits nickase activity; b) a modifying enzyme (e.g., a DNA-modifying enzyme or a protein-modifying enzyme); and c) a DNA polymerase. The RNA-guided enzyme that exhibits nickase activity, together with a guide RNA, guides the fusion polypeptide to a target nucleotide sequence in a target nucleic acid (e.g., a genome).

In some cases, a fusion polypeptide of the present disclosure (e.g., a fusion polypeptide comprising: a) an RNA-guided enzyme that exhibits nickase activity; b) a DNA- or protein-modifying enzyme; and c) a DNA polymerase) is a base editor. Thus, in some cases, a base editor of the present disclosure is a fusion polypeptide comprising: a) an RNA-guided enzyme that exhibits nickase activity; b) a DNA- or protein-modifying enzyme; and c) a DNA polymerase. In some cases, a base editor fusion polypeptide of the present disclosure comprises, in order from N-terminus to C-terminus: a) an RNA-guided enzyme that exhibits nickase activity; b) a DNA- or protein-modifying enzyme; and c) a DNA polymerase. In some cases, a base editor fusion polypeptide of the present disclosure comprises, in order from N-terminus to C-terminus: a) a DNA polymerase; b) an RNA-guided enzyme that exhibits nickase activity; and c) a DNA-modifying enzyme. In some cases, a base editor fusion polypeptide of the present disclosure comprises, in order from N-terminus to C-terminus: a) a DNA- or protein-modifying enzyme; b) an RNA-guided enzyme that exhibits nickase activity; and c) a DNA polymerase. In these embodiments, the DNA polymerase can be a high-fidelity DNA polymerase, or a DNA polymerase that lacks substantial proofreading activity. In some cases, the DNA polymerase comprises a D424A substitution.

Suitable DNA- and protein-modifying enzymes are known in the art. In some cases, the modifying enzyme is a nucleic acid-modifying enzyme. Examples of suitable nucleic acid-modifying enzymes include DNA editing enzymes; deaminases, such as activation induced deaminase and APOBEC proteins; nucleases; recombinases; glycosylases; methyltransferases; and the like. In other cases, the modifying enzyme is a protein-modifying enzyme. For example, the modifying enzyme may be one that modifies a protein associated with a nucleic acid. Examples of suitable protein-modifying enzymes include histone-modifying enzymes, acetylases, kinases, methyltransferases, ubiquitin ligases, SUMO ligases, demethylases, deacetylases, phosphatases, and the like.

In some cases, a base editor fusion polypeptide of the present disclosure comprises, in order from N-terminus to C-terminus: a) a deaminase; b) a DNA polymerase; and c) an RNA-guided enzyme that exhibits nickase activity. Suitable deaminases include a cytidine deaminase and an adenosine deaminase. In some cases, a base editor fusion polypeptide of the present disclosure comprises, in order from N-terminus to C-terminus: a) a cytidine deaminase; b) an RNA-guided enzyme that exhibits nickase activity; and c) a DNA polymerase. In some cases, a base editor fusion polypeptide of the present disclosure comprises, in order from N-terminus to C-terminus: a) an adenine deaminase; b) an RNA-guided enzyme that exhibits nickase activity; and c) a DNA polymerase. In these embodiments, the DNA polymerase can be a high-fidelity DNA polymerase, or a DNA polymerase that lacks substantial proofreading activity. In some cases, the DNA polymerase comprises a D424A substitution. In some cases, the fusion polypeptide comprises a linker between the deaminase and the DNA polymerase, between the deaminase and the gene-editing enzyme, or between the gene-editing enzyme and the DNA polymerase.

In some cases, a deaminase-containing base editor system of the present disclosure provides for generation of a G→T substitution. In some cases, a deaminase-containing base editor system of the present disclosure provides for generation of a G→C substitution. In some cases, a deaminase-containing base editor system of the present disclosure provides for generation of a C→A substitution. In some cases, a deaminase-containing base editor system of the present disclosure provides for generation of a C→G substitution. In some cases, a deaminase-containing base editor system of the present disclosure provides for generation of an A→T substitution. In some cases, a deaminase-containing base editor system of the present disclosure provides for generation of an A→G substitution. In some cases, a deaminase-containing base editor system of the present disclosure provides for generation of an A→C substitution. In some cases, a deaminase-containing base editor system of the present disclosure provides for generation of a T→A substitution. In some cases, a deaminase-containing base editor system of the present disclosure provides for generation of a T→G substitution. In some cases, a deaminase-containing base editor system of the present disclosure provides for generation of a T→C substitution. In some cases, a deaminase-containing base editor system of the present disclosure provides for generation of a G→A substitution. In some cases, a deaminase-containing base editor system of the present disclosure provides for generation of a C→T substitution.

DNA Polymerase

A DNA- or protein-modifying enzyme-containing fusion polypeptide of the present disclosure (e.g., a deaminase-containing base editor of the present disclosure) comprises a DNA polymerase that is a high-fidelity DNA polymerase. In some cases, a DNA- or protein-modifying enzyme-containing fusion polypeptide of the present disclosure comprises a DNA polymerase lacks proof-reading activity. In some cases, a DNA- or protein-modifying enzyme-containing fusion polypeptide of the present disclosure comprises a DNA polymerase comprises a D424A substitution that exhibits increase nick translation activity. In some cases, a DNA- or protein-modifying enzyme-containing fusion polypeptide of the present disclosure comprises a DNA polymerase is not an error-prone DNA polymerase.

Previous base-editors fused a DNA-editing enzyme to a programmable nuclease; such a fusion protein will chemically modify a target nucleotide in such a way that DNA polymerases will incorporate across from the chemically modified nucleotide a nucleotide that is not the same nucleotide type originally at this position. However, these previous base-editors rely on replication or repair machinery to perform this DNA polymerase-mediated new nucleotide insertion. A base editor fusion polypeptide of the present disclosure fuses a nick translating DNA polymerase to a deaminase and an RNA-guided enzyme that provides nickase activity, such that the chemically altered nucleotide will be used as a template for the fused DNA polymerase-mediated nick translation. This removes the dependence on replication and repair to achieve base-editing.

In some cases, a deaminase-containing base editor of the present disclosure comprises a DNA polymerase lacks proof-reading activity. In some cases, a deaminase-containing base editor of the present disclosure comprises a DNA polymerase comprises a D424A substitution that exhibits increase nick translation activity. In some cases, a deaminase-containing base editor of the present disclosure comprises a DNA polymerase is not an error-prone DNA polymerase.

In some cases, DNA- or protein-modifying enzyme-containing fusion polypeptide of the present disclosure (e.g., a deaminase-containing base editor of the present disclosure) comprises a DNA polymerase that comprises an amino acid sequence having at least 80%, at least 85%, at least 90%, at least 95%, at least 98%, at least 99%, or 100%, amino acid sequence identity to the following *E. coli* DNA polymerase I amino acid sequence:

(SEQ ID NO: 1246)
VQIPQNPLILVDGSSYLYRAYHAFPPLTNSAGEPTGAMYG

VLNMLRSLIMQYKPTHAAVVFDAKGKTFRDELFEHYKSH

RPPMPDDLRAQIEPLHAMVKAMGLPLLAVSGVEADDVIGT

LAREAEKAGRPVLISTGDKDMAQLVTPNITLINTMTNTIL

GPEEVVNKYGVPPELIIDFLALMGDSSDNIPGVPGVGEKT

AQALLQGLGGLDTLYAEPEKIAGLSFRGAKTMAAKLEQNK

EVAYLSYQLATIKTDVELELTCEQLEVQQPAAEELLGLFK

KYEFKRWTADVEAGKWLQAKGAKPAAKPQETSVADEAPEV

TATVISYDNYVTILDEETLKAWIAKLEKAPVFAFDTETDS

LDNISANLVGLSFAIEPGVAAYIPVAHDYLDAPDQISRER

ALELLKPLLEDEKALKVGQNLKYDRGILANYGIELRGIAF

DTMLESYILNSVAGRHDMDSLAERWLKHKTITFEEIAGKG

KNQLTFNQIALEEAGRYAAEDADVTLQLHLKMWPDLQKHK

GPLNVFENIEMPLVPVLSRIERNGVKIDPKVLHNHSEELT

LRLAELEKKAHEIAGEEFNLSSTKQLQTILFEKQGIKPLK

KTPGGAPSTSEEVLEELALDYPLPKVILEYRGLAKLKSTY

TDKLPLMINPKTGRVHTSYHQAVTATGRLSSTDPNLQNIP

VRNEEGRRIRQAFIAPEDYVIVSADYSQIELRIMAHLSRD

KGLLTAFAEGKDIHRATAAEVFGLPLETVTSEQRRSAKAI

NFGLIYGMSAFGLARQLNIPRKEAQKYMDLYFERYPGVLE

YMERTRAQAKEQGYVETLDGRRLYLPDIKSSNGARRAAAE

RAAINAPMQGTAADIIKRAMIAVDAWLQAEQPRVRMIMQV

HDELVFEVHKDDVDAVAKQIHQLMENCTRLDVPLLVEVGS

GENWDQAH.

In some cases, a DNA- or protein-modifying enzyme-containing fusion polypeptide of the present disclosure (e.g., a deaminase-containing base editor of the present disclosure) comprises a DNA polymerase that comprises an amino acid sequence having at least 80%, at least 85%, at least 90%, at least 95%, at least 98%, at least 99%, or 100%, amino acid sequence identity to the following exonuclease-deficient *E. coli* DNA polymerase I amino acid sequence:

(SEQ ID NO: 1144)
VQIPQNPLILVDGSSYLYRAYHAFPPLTNSAGEPTGAMYGVLNMLRSLI

MQYKPTHAAVVFDAKGKTFRDELFEHYKSHRPPMPDDLRAQIEPLHAMV

KAMGLPLLAVSGVEADDVIGTLAREAEKAGRPVLISTGDKDMAQLVTPN

ITLINTMTNTILGPEEVVNKYGVPPELIIDFLALMGDSSDNIPGVPGVG

EKTAQALLQGLGGLDTLYAEPEKIAGLSFRGAKTMAAKLEQNKEVAYLS

YQLATIKTDVELELTCEQLEVQQPAAEELLGLFKKYEFKRWTADVEAGK

WLQAKGAKPAAKPQETSVADEAPEVTATVISYDNYVTILDEETLKAWIA

-continued
KLEKAPVFAFDTETDSLDNISANLVGLSFAIEPGVAAYIPVAHDYLDAP

DQISRERALELLKPLLEDEKALKVGQNLKYARGILANYGIELRGIAFDT

MLESYILNSVAGRHDMDSLAERWLKHKTITFEEIAGKGKNQLTFNQIAL

EEAGRYAAEDADVTLQLHLKMWPDLQKHKGPLNVFENIEMPLVPVLSRI

ERNGVKIDPKVLHNHSEELTLRLAELEKKAHEIAGEEFNLSSTKQLQTI

LFEKQGIKPLKKTPGGAPSTSEEVLEELALDYPLPKVILEYRGLAKLKS

TYTDKLPLMINPKTGRVHTSYHQAVTATGRLSSTDPNLQNIPVRNEEGR

RIRQAFIAPEDYVIVSADYSQIELRIMAHLSRDKGLLTAFAEGKDIHRA

TAAEVFGLPLETVTSEQRRSAKAINFGLIYGMSAFGLARQLNIPRKEAQ

KYMDLYFERYPGVLEYMERTRAQAKEQGYVETLDGRRLYLPDIKSSNGA

RRAAAERAAINAPMQGTAADIIKRAMIAVDAWLQAEQPRVRMIMQVHDE

LVFEVHKDDVDAVAKQIHQLMENCTRLDVPLLVEVGSGENWDQAH

Modifying Enzymes

As noted above, suitable DNA- and protein-modifying enzymes are known in the art. In some cases, the modifying enzyme is a nucleic acid-modifying enzyme. Examples of suitable nucleic acid-modifying enzymes include DNA editing enzymes; deaminases, such as activation induced deaminase and APOBEC proteins; nucleases; recombinases; glycosylases; methyltransferases; and the like. In other cases, the modifying enzyme is a protein-modifying enzyme. For example, the modifying enzyme may be one that modifies a protein associated with a nucleic acid. Examples of suitable protein-modifying enzymes include histone-modifying enzymes, acetylases, kinases, methyltransferases, ubiquitin ligases, SUMO ligases, demethylases, deacetylases, phosphatases, and the like.

Adenosine Deaminases

Adenosine deaminases suitable for inclusion in a deaminase-containing base editor of the present disclosure include any enzyme that is capable of deaminating adenosine in DNA. In some cases, the deaminase is a TadA deaminase.

In some cases, a suitable adenosine deaminase comprises an amino acid sequence having at least 80%, at least 85%, at least 90%, at least 95%, at least 98%, at least 99%, or 100%, amino acid sequence identity to the following amino acid sequence:

(SEQ ID NO: 1247)
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSR

IGRVVFGARDAKTGAAGSLMDVLHHPGMNHRVEITEGILADECAALLSD

FFRMRRQEIKAQKKAQSSTD

In some cases, a suitable adenosine deaminase comprises an amino acid sequence having at least 80%, at least 85%, at least 90%, at least 95%, at least 98%, at least 99%, or 100%, amino acid sequence identity to the following amino acid sequence:

(SEQ ID NO: 1248)
MRRAFITGVFFLSEVEFSHEYWMRHALTLAKRAWDEREVPVGAVLVHNN

RVIGEGWNRPIGRHDPTAHAEIMALRQGGLVMQNYRLIDATLYVTLEPC

VMCAGAMIHSRIGRVVFGARDAKTGAAGSLMDVLHHPGMNHRVEITEGI

LADECAALLSDFFRMRRQEIKAQKKAQSSTD.

In some cases, a suitable adenosine deaminase comprises an amino acid sequence having at least 80%, at least 85%, at least 90%, at least 95%, at least 98%, at least 99%, or 100%, amino acid sequence identity to the following *Staphylococcus aureus* TadA amino acid sequence:

(SEQ ID NO: 1200)
MGSHMTNDIYFMTLAIEEAKKAAQLGEVPIGAIITKDDEVIARAHNLRE

TLQQPTAHAEHIAIERAAKVLGSWRLEGCTLYVTLEPCVMCAGTIVMSR

IPRVVYGADDPKGGCSGSLMNLLQQSNFNHRAIVDKGVLKEACSTLLTT

FFK NLRANKKSTN:

In some cases, a suitable adenosine deaminase comprises an amino acid sequence having at least 80%, at least 85%, at least 90%, at least 95%, at least 98%, at least 99%, or 100%, amino acid sequence identity to the following *Bacillus subtilis* TadA amino acid sequence:

(SEQ ID NO: 1201)
MTQDELYMKEAIKEAKKAEEKGEVPIGAVLVINGEIIARAHNLRETEQR

SIAHAEMLVIDEACKALGTWRLEGATLYVTLEPCPMCAGAVVLSRVEKV

VFGAFDPKGGCSGTLMNLLQEERFNHQAEVVSGVLEEECGGMLSAFFRE

LRKKKKAARKNLSE

In some cases, a suitable adenosine deaminase comprises an amino acid sequence having at least 80%, at least 85%, at least 90%, at least 95%, at least 98%, at least 99%, or 100%, amino acid sequence identity to the following *Salmonella typhimurium* TadA:

(SEQ ID NO: 1202)
MPPAFITGVTSLSDVELDHEYWMRHALTLAKRAWDEREVPVGAVLVHNH

RVIGEGWNRPIGRHDPTAHAEIMALRQGGLVLQNYRLLDTTLYVTLEPC

VMCAGAMVHSRIGRVVFGARDAKTGAAGSLIDVLHHPGMNHRVEIIEGV

LRDECATLLSDFFRMRRQEIKALKKADRAEGAGPAV

In some cases, a suitable adenosine deaminase comprises an amino acid sequence having at least 80%, at least 85%, at least 90%, at least 95%, at least 98%, at least 99%, or 100%, amino acid sequence identity to the following *Shewanella putrefaciens* TadA amino acid sequence: NO:1203)

(SEQ ID NO: 1203)
MDEYWMQVAMQMAEKAEAAGEVPVGAVLVKDGQQIATGYNLSISQHDPT

AHAEILCLRSAGKKLENYRLLDATLYITLEPCAMCAGAMVHSRIARVVY

GARDEKTGAAGTVVNLLQHPAFNHQVEVTSGVLAEACSAQLSRFFKRRR

DEKKALKLAQRAQQGIE

In some cases, a suitable adenosine deaminase comprises an amino acid sequence having at least 80%, at least 85%, at least 90%, at least 95%, at least 98%, at least 99%, or 100%, amino acid sequence identity to the following *Haemophilus influenzae* F3031 TadA amino acid sequence:

(SEQ ID NO: 1204)
MDAAKVRSEFDEKMMRYALELADKAEALGEIPVGAVLVDDARNIIGEGW

NLSIVQSDPTAHAEIIALRNGAKNIQNYRLLNSTLYVTLEPCTMCAGAI

LHSRIKRLVFGASDYKTGAIGSRFHFFDDYKMNHTLEITSGVLAEECSQ

KLS TFFQKRREEKKIEKALLKSLSDK

In some cases, a suitable adenosine deaminase comprises an amino acid sequence having at least 80%, at least 85%, at least 90%, at least 95%, at least 98%, at least 99%, or 100%, amino acid sequence identity to the following *Caulobacter crescentus* TadA amino acid sequence:

(SEQ ID NO: 1205)
MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI

In some cases, a suitable adenosine deaminase comprises an amino acid sequence having at least 80%, at least 85%, at least 90%, at least 95%, at least 98%, at least 99%, or 100%, amino acid sequence identity to the following Geobacter sulfurreducens TadA amino acid sequence:

(SEQ ID NO: 1206)
MSSLKKTPIRDDAYWMGKAIREAAKAAARDEVPIGAVIVRDGAVIGRGH

NLREGSNDPSAHAEMIAIRQAARRSANWRLTGATLYVTLEPCLMCMGAI

ILARLERVVFGCYDPKGGAAGSLYDLSADPRLNHQVRLSPGVCQEECGT

MLSDFFRDLRRRKKAKATPALFIDERKVPPEP

Cytidine Deaminases

Cytidine deaminases suitable for inclusion in a deaminase-containing base editor of the present disclosure include any enzyme that is capable of deaminating cytidine in DNA.

In some cases, the cytidine deaminase is a deaminase from the apolipoprotein B mRNA-editing complex (APOBEC) family of deaminases. In some cases, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase. In some cases, the cytidine deaminase is an activation induced deaminase (AID).

In some cases, a suitable cytidine deaminase comprises an amino acid sequence having at least 80%, at least 85%, at least 90%, at least 95%, at least 98%, at least 99%, or 100%, amino acid sequence identity to the following amino acid sequence:

(SEQ ID NO: 1207)
MDSLLMNRRKFLYQFKNVRWAKGRRETYLCYVVKRRDSATSFSLDFGYL

RNKNGCHVELLFLRYISDWDLDPGRCYRVTWFTSWSPCYDCARHVADFL

RGNPNLSLRIFTARLYFCEDRKAEPEGLRRLHRAGVQIAIMTFKDYFYC

WNTFVENHERTFKAWEGLHENSVRLSRQLRRILLPLYEVDDLRDAFRTL

GL

In some cases, a suitable cytidine deaminase is an AID and comprises an amino acid sequence having at least 80%, at least 85%, at least 90%, at least 95%, at least 98%, at least 99%, or 100%, amino acid sequence identity to the following amino acid sequence: MDSLLMNRRK FLYQFKNVRW AKGRRETYLC YVVKRRDSAT SFSLDFGYLR NKNGCHVELL FLRYISDWDL DPGRCYRVTW FTSWSPCYDC ARHVADFLRG NPNLSLRIFT ARLYFCEDRK AEPEGLRRLH RAGVQIAIMT FKENHERTFK AWEGLHENSV RLSRQLRRIL LPLYEVDDLR DAFRTLGL (SEQ ID NO:1208).

In some cases, a suitable cytidine deaminase is an AID and comprises an amino acid sequence having at least 80%, at least 85%, at least 90%, at least 95%, at least 98%, at least 99%, or 100%, amino acid sequence identity to the following amino acid sequence: MDSLLMNRRK FLYQFKNVRW AKGRRETYLC YVVKRRDSAT SFSLDFGYLR NKNGCHVELL FLRYISDWDL DPGRCYRVTW FTSWSPCYDC ARHVADFLRG NPNLSLRIFT ARLYFCEDRK AEPEGLRRLH RAGVQIAIMT FKDYFYCWNT FVENHERTFK AWEGLHENSV RLSRQLRRIL LPLYEVDDLR DAFRTLGL (SEQ ID NO:1209).

RNA-Guided Enzyme Exhibiting Nickase Activity

As noted above, a DNA- or protein-modifying enzyme-containing fusion polypeptide of the present disclosure (e.g., a deaminase-containing base editor of the present disclosure) comprises an RNA-guided enzyme that exhibits nickase activity. Suitable nickases are described elsewhere herein.

In some cases, a suitable RNA-guided enzyme that exhibits nickase activity comprises an amino acid sequence having at least 80%, at least 85%, at least 90%, at least 95%, at least 98%, at least 99%, or 100%, amino acid sequence identity to the following "nicking high fidelity" Cas9 amino acid sequence:

```
                                    (SEQ ID NO: 1210)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTAFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGALSRKLINGIRDKQSGKTILDFLKSDG

FANRNFMALIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRAITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD.
```

In some cases, a suitable RNA-guided enzyme that exhibits nickase activity comprises an amino acid sequence having at least 80%, at least 85%, at least 90%, at least 95%, at least 98%, at least 99%, or 100%, amino acid sequence identity to the following "nicking enhanced" Cas9 amino acid sequence:

```
                                    (SEQ ID NO: 1211)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLADDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPALESEFVYGDYKVYDVRKMIAKSEQEIG

KATAKYFFYSNIMNFFKTEITLANGEIRKAPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN
```

```
                                    -continued
PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD.
```

In some cases, a suitable RNA-guided enzyme that exhibits nickase activity comprises an amino acid sequence having at least 80%, at least 85%, at least 90%, at least 95%, at least 98%, at least 99%, or 100%, amino acid sequence identity to the following "nicking" Cas9 amino acid sequence:

```
                                                     (SEQ ID NO: 1212)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD.
```

UGI

In some cases, a DNA- or protein-modifying enzyme-containing fusion polypeptide of the present disclosure (e.g., a deaminase-containing base editor of the present disclosure) further includes a uracil glycosylase inhibitor (UGI) polypeptide. The UGI polypeptide can be positioned at the N-terminus, at the C-terminus, or internally within the fusion polypeptide.

In some cases, a suitable UGI polypeptide comprises an amino acid sequence having at least 80%, at least 85%, at least 90%, at least 95%, at least 98%, at least 99%, or 100%, amino acid sequence identity to the following amino acid sequence:

```
                                                     (SEQ ID NO: 1213)
TNLSDIIEKETGKQLVIQESILMLPEEVEEVIGNKPESDILVHTAYDES

TDENVMLLTSDAPEYKPWALVIQDSNGENKIKML.
```

NLS

In some cases, a DNA- or protein-modifying enzyme-containing fusion polypeptide of the present disclosure (e.g., a deaminase-containing base editor of the present disclosure) includes a nuclear localization signal (NLS). In some cases, a DNA- or protein-modifying enzyme-containing fusion polypeptide of the present disclosure (e.g., a deaminase-containing base editor of the present disclosure) comprises a single NLS at the N-terminus of the fusion polypeptide. In some cases, a DNA- or protein-modifying enzyme-containing fusion polypeptide of the present disclosure (e.g., a deaminase-containing base editor of the present disclosure) comprises 2, 3, or 4 NLSs at the N-terminus of the fusion polypeptide. In other instances, a DNA- or protein-modifying enzyme-containing fusion polypeptide of the present disclosure (e.g., a deaminase-containing base editor of the present disclosure) comprises a single NLS at the C-terminus of the fusion polypeptide. In some cases, a DNA- or protein-modifying enzyme-containing fusion polypeptide of the present disclosure (e.g., a deaminase-containing base editor of the present disclosure) comprises 2, 3, or 4 NLSs at the C-terminus of the fusion polypeptide.

Non-limiting examples of suitable NLSs include an NLS sequence derived from: the NLS of the SV40 virus large T-antigen, having the amino acid sequence PKKKRKV (SEQ ID NO:1172); the NLS from nucleoplasmin (e.g., the nucleoplasmin bipartite NLS with the sequence KRPAATKKAGQAKKKK (SEQ ID NO:1173)); the c-myc NLS having the amino acid sequence PAAKRVKLD (SEQ ID NO:1174) or RQRRNELKRSP (SEQ ID NO:1175); the hRNPA1 M9 NLS having the sequence NQSSNFGPMKGGNFGGRSSGPYGGGGQYFAK-PRNQGGY (SEQ ID NO:1176); the sequence RMRIZFKNKGKDTAELRRRRVEVSVELRKAKKD-EQILKRRNV (SEQ ID NO:1177) of the IBB domain from importin-alpha; the sequences VSRKRPRP (SEQ ID NO:1178) and PPKKARED (SEQ ID NO:1179) of the myoma T protein; the sequence PQPKKKPL (SEQ ID NO:1180) of human p53; the sequence SALIKKKKKMAP (SEQ ID NO:1181) of mouse c-abl IV; the sequences DRLRR (SEQ ID NO:1182) and PKQKKRK (SEQ ID NO:1183) of the influenza virus NS1; the sequence RKLKKKIKKL (SEQ ID NO:1185) of the Hepatitis virus delta antigen; the sequence REKKKFLKRR (SEQ ID NO:1185) of the mouse Mx1 protein; the sequence KRKGDEVDGVDEVAKKKSKK (SEQ ID NO:1186) of the human poly(ADP-ribose) polymerase; and the sequence RKCLQAGMNLEARKTKK (SEQ ID NO:1187) of the steroid hormone receptors (human) glucocorticoid. In some cases, an NLS comprises the amino acid sequence MDSLL-MNRRKFLYQFKNVRWAKGRRETYLC (SEQ ID NO:1188). In general, NLS (or multiple NLSs) are of sufficient strength to drive accumulation of the fusion polypeptide in a detectable amount in the nucleus of a eukaryotic cell. Detection of accumulation in the nucleus may be performed by any suitable technique. For example, a detectable marker may be fused to the fusion polypeptide such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

System Comprising a Modifying Enzyme-Containing Fusion Protein

The present disclosure provides a system comprising a DNA- or protein-modifying enzyme-containing fusion polypeptide of the present disclosure (e.g., a deaminase-containing base editor of the present disclosure). The system comprises: a) the DNA- or protein-modifying enzyme-containing fusion polypeptide; and b) a guide RNA.

The present disclosure provides a base-editing system comprising a deaminase-containing base editor of the present disclosure. The system comprises: a) a base-editing system comprising a deaminase-containing base editor of the present disclosure; and b) a guide RNA. In some cases, the guide RNA is a single-molecule guide RNA. In some cases, the guide RNA is a dual-molecule guide RNA. In some cases, the guide RNA comprises a modified base and/or a modified sugar and/or a non-naturally occurring internucleoside linkage, as described above.

EXAMPLES OF NON-LIMITING ASPECTS OF THE DISCLOSURE

Aspects, including embodiments, of the present subject matter described above may be beneficial alone or in combination, with one or more other aspects or embodiments. Without limiting the foregoing description, certain non-limiting aspects of the disclosure numbered 1-84 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. A fusion polypeptide comprising: a) an enzymatically active RNA-guided endonuclease that introduces a single-stranded break in a target DNA; and b) an error-prone DNA polymerase.

Aspect 2. The fusion polypeptide of aspect 1, wherein the RNA-guided endonuclease is a class 2 CRISPR/Cas endonuclease.

Aspect 3. The fusion polypeptide of aspect 2, wherein the class 2 CRISPR/Cas endonuclease is a type V or type VI CRISPR/Cas endonuclease.

Aspect 4. The fusion polypeptide of aspect 2, wherein the class 2 CRISPR/Cas endonuclease is a Cas9 polypeptide.

Aspect 5. The fusion polypeptide of aspect 4, wherein the Cas9 polypeptide comprises a mutation that reduces off-target binding.

Aspect 6. The fusion polypeptide of aspect 3, wherein the RNA-guided endonuclease is a Cpf1 polypeptide.

Aspect 7. The fusion polypeptide of any one of aspects 1-6, further comprising a nuclear localization signal.

Aspect 8. The fusion polypeptide of any one of aspects 1-7, comprising a linker interposed between the RNA-guided endonuclease and the error-prone DNA polymerase.

Aspect 9. The fusion polypeptide of any one of aspects 1-8, further comprising a DNA-binding polypeptide that increases the processivity of the DNA polymerase.

Aspect 10. The fusion polypeptide of aspect 9, wherein the DNA-binding polypeptide that increases the processivity of the DNA polymerase is an Sso7d polypeptide.

Aspect 11. The fusion polypeptide of aspect 9, wherein the DNA-binding polypeptide that increases the processivity of the DNA polymerase is a helix-hairpin-helix domain of topoisomerase I.

Aspect 12. The fusion polypeptide of aspect 9, wherein the DNA-binding polypeptide that increases the processivity of the DNA polymerase is a thioredoxin binding domain of a T7 DNA polymerase or T3 polymerase.

Aspect 13. The fusion polypeptide of any one of aspects 1-12, wherein the fusion polypeptide, when complexed with a guide RNA, exhibits a target mutation rate of from $10^{-8}$ to $10^{-2}$ mutations per nucleotide per genome replication event.

Aspect 14. The fusion polypeptide of any one of aspects 1-12, wherein the fusion polypeptide, when complexed with a guide RNA, exhibits a target mutation rate of from $10^{-6}$ to $10^{-5}$ mutations per nucleotide per genome replication event.

Aspect 15. The fusion polypeptide of any one of aspects 1-12, wherein the fusion polypeptide, when complexed with a guide RNA, exhibits a target mutation rate of from $10^{-5}$ to $10^{-3}$ mutations per nucleotide per genome replication event.

Aspect 16. The fusion polypeptide of any one of aspects 1-12, wherein the fusion polypeptide, when complexed with a guide RNA, exhibits a target mutation rate of from $10^{-3}$ to $10^{-2}$ mutations per nucleotide per genome replication event.

Aspect 17. The fusion polypeptide of any one of aspects 1-12, wherein the fusion polypeptide, when complexed with a guide RNA, exhibits a target mutation rate that is at least 5-fold higher than the global mutation rate exhibited by the error-prone DNA polymerase not fused to the RNA-guided endonuclease.

Aspect 18. The fusion polypeptide of any one of aspects 1-12, wherein the fusion polypeptide, when complexed with a guide RNA, exhibits a target mutation rate that is at least 10-fold higher than the global mutation rate exhibited by the error-prone DNA polymerase not fused to the RNA-guided endonuclease.

Aspect 19. The fusion polypeptide of any one of aspects 1-12, wherein the fusion polypeptide, when complexed with a guide RNA, exhibits a target mutation rate that is at least 102-fold higher than the global mutation rate exhibited by the error-prone DNA polymerase not fused to the RNA-guided endonuclease.

Aspect 20. The fusion polypeptide of any one of aspects 1-19, wherein the fusion polypeptide, when complexed with a guide RNA, introduces mutations at a distance of from 1 nucleotide to 104 nucleotides from a nick in a target DNA introduced by the RNA-guided endonuclease.

Aspect 21. The fusion polypeptide of any one of aspects 1-19, wherein the fusion polypeptide, when complexed with a guide RNA, introduces mutations at a distance of from 1 nucleotide to 100 nucleotides from a nick in a target DNA introduced by the RNA-guided endonuclease.

Aspect 22. The fusion polypeptide of any one of aspects 1-19, wherein the fusion polypeptide, when complexed with a guide RNA, introduces mutations at a distance of from 1 nucleotide to 50 nucleotides from a nick in a target DNA introduced by the RNA-guided endonuclease.

Aspect 23. The fusion polypeptide of any one of aspects 1-22, wherein the fusion polypeptide comprises, in order from N-terminus to C-terminus: a) the enzymatically active RNA-guided endonuclease; and b) the error-prone DNA polymerase.

Aspect 24. The fusion polypeptide of any one of aspects 1-22, wherein the fusion polypeptide comprises, in order from N-terminus to C-terminus: a) the enzymatically active RNA-guided endonuclease; b) a linker; and c) the error-prone DNA polymerase.

Aspect 25. The fusion polypeptide of any one of aspects 1-22, wherein the fusion polypeptide comprises, in order from N-terminus to C-terminus: a) the error-prone DNA polymerase; and b) the enzymatically active RNA-guided endonuclease.

Aspect 26. The fusion polypeptide of any one of aspects 1-22, wherein the fusion polypeptide comprises, in order from N-terminus to C-terminus: a) the error-prone DNA polymerase; b) a linker; and c) the enzymatically active RNA-guided endonuclease.

Aspect 27. The fusion polypeptide of any one of aspects 1-26, wherein the fusion polypeptide comprises, in order from N-terminus to C-terminus a) a nuclear localization signal; b) an enzymatically inactive RNA-guided endonuclease; and c) an error-prone DNA polymerase.

Aspect 28. The fusion polypeptide of any one of aspects 1-26, wherein the fusion polypeptide comprises, in order from N-terminus to C-terminus: a) a nuclear localization signal; b) an error-prone DNA polymerase; and c) an enzymatically inactive RNA-guided endonuclease.

Aspect 29. The fusion polypeptide of any one of aspects 28, wherein the DNA polymerase comprises an amino acid sequence having at least 85% amino acid sequence to the DNA polymerase I amino acid sequence depicted in FIG. 8, wherein the DNA polymerase has one or more of the following: an Ala at amino acid position 242, an Asn at amino acid position 709, an Arg at amino acid position 759, a Tyr at amino acid position 742, and a His at amino acid position 796.

Aspect 30. The fusion polypeptide of any one of aspects 28, wherein the DNA polymerase is a DNA polymerase beta, a DNA polymerase iota, a DNA polymerase nu, a DNA polymerase eta, or a DNA polymerase kappa.

Aspect 31. The fusion polypeptide of aspect 30, wherein the fusion polypeptide, when complexed with a guide RNA, exhibits a target mutation rate of 1 mutation per nucleotide per genome replication event.

Aspect 32. A system comprising: a) the fusion polypeptide of any one of aspects 1-31; and b) a guide RNA that comprises: i) a protein-binding segment comprising a nucleotide sequence that binds to the RNA-guided endonuclease; and ii) a target-binding segment comprising a nucleotide sequence that is complementary to a target nucleotide sequence in a target nucleic acid.

Aspect 33. The system of aspect 32, wherein the guide RNA is a single-molecule guide RNA.

Aspect 34. The system of aspect 32, wherein the guide RNA is a dual-molecule guide RNA.

Aspect 35. The system of any one of aspects 32-34, wherein the guide RNA comprises one or more of: a) a modified base; b) a modified backbone; c) a modified sugar moiety; and d) a non-natural internucleoside linkage.

Aspect 36. A cell comprising the fusion polypeptide of any one of aspects 1-31.

Aspect 37. The cell of aspect 36, wherein the cell is a prokaryotic cell.

Aspect 38. The cell of aspect 36, wherein the cell is a eukaryotic cell.

Aspect 39. The cell of any one of aspects 36-38, wherein the cell is in vitro.

Aspect 40. A cell comprising the system of any one of aspects 36-39.

Aspect 41. The cell of aspect 40, wherein the cell is a prokaryotic cell.

Aspect 42. The cell of aspect 40, wherein the cell is a eukaryotic cell.

Aspect 43. The cell of any one of aspects 40-42, wherein the cell is in vitro.

Aspect 44. A method of mutagenizing a target DNA, the method comprising contacting the target DNA with the system of any one of aspects 32-35.

Aspect 45. The method of aspect 44, wherein the target DNA is present in a cell.

Aspect 46. The method of aspect 44, wherein the cell is a prokaryotic cell.

Aspect 47. The method of aspect 45, wherein the cell is a eukaryotic cell.

Aspect 48. The method of aspect 47, wherein the cell is an animal cell.

Aspect 49. The method of aspect 47, wherein the cell is a plant cell.

Aspect 50. The method of aspect 49, wherein the plant cell is a cell of a dicotyledon.

Aspect 51. The method of aspect 49, wherein the plant cell is a cell of a monocotyledon.

Aspect 52. The method of any one of aspects 44-51, wherein the cell is in vitro.

Aspect 53. The method of any one of aspects 44-51, wherein the cell is in vivo.

Aspect 54. The method of any one of aspects 44-53, wherein mutations are introduced into the target DNA at a mutation rate of from 108 to $10^{-2}$ mutations per nucleotide per genome replication event.

Aspect 55. The method of any one of aspects 44-53, wherein mutations are introduced into the target DNA at a mutation rate of from 106 to 105 mutations per nucleotide per genome replication event.

Aspect 56. The method of any one of aspects 44-53, wherein mutations are introduced into the target DNA at a mutation rate of from 105 to $10^{-3}$ mutations per nucleotide per genome replication event.

Aspect 57. The method of any one of aspects 44-53, wherein mutations are introduced into the target DNA at a mutation rate of from 103 to $10^{-2}$ mutations per nucleotide per genome replication event.

Aspect 58. A base editor system comprising: a) the fusion polypeptide of any one of aspects 29-31; and b) a guide RNA that comprises: i) a protein-binding segment comprising a nucleotide sequence that binds to the RNA-guided endonuclease; and ii) a target-binding segment comprising a nucleotide sequence that is complementary to a target nucleotide sequence in a target nucleic acid.

Aspect 59. The system of aspect 58, wherein the guide RNA is a single-molecule guide RNA.

Aspect 60. The system of aspect 58, wherein the guide RNA is a dual-molecule guide RNA.

Aspect 61. The system of any one of aspects 58-60, wherein the guide RNA comprises one or more of: a) a modified base; b) a modified backbone; c) a modified sugar moiety; and d) a non-natural internucleoside linkage.

Aspect 62. A method of editing a target nucleotide sequence in a target nucleic acid, the method comprising contacting the target nucleotide sequence with the base editor system of any one of aspects 58-61.

Aspect 63. The method of aspect 62, wherein the target nucleotide sequence comprises a single nucleotide mutation that results in a disease or disorder in an organism.

Aspect 64. A fusion polypeptide comprising: a) an enzymatically active RNA-guided endonuclease that introduces a single-stranded break in a target DNA; b) a DNA polymerase; and c) modifying enzyme.

Aspect 65. The fusion polypeptide of aspect 64, wherein the modifying enzyme is a protein-modifying enzyme.

Aspect 66. The fusion polypeptide of aspect 64, wherein the modifying enzyme is a DNA-modifying enzyme.

Aspect 67. The fusion polypeptide of aspect 66, wherein the DNA-modifying enzyme is a cytidine deaminase or an adenosine deaminase.

Aspect 68. The fusion polypeptide of aspect 64, wherein the RNA-guided endonuclease is a class 2 CRISPR/Cas endonuclease.

Aspect 69. The fusion polypeptide of aspect 68, wherein the class 2 CRISPR/Cas endonuclease is a type V or type VI CRISPR/Cas endonuclease.

Aspect 70. The fusion polypeptide of aspect 68, wherein the class 2 CRISPR/Cas endonuclease is a Cas9 polypeptide.

Aspect 71. The fusion polypeptide of aspect 70, wherein the Cas9 polypeptide comprises a mutation that reduces off-target binding.

Aspect 72. The fusion polypeptide of aspect 64, wherein the RNA-guided endonuclease is a Cpf1 polypeptide.

Aspect 73. The fusion polypeptide of any one of aspects 64-72, further comprising a nuclear localization signal.

Aspect 74. The fusion polypeptide of any one of aspects 64-73, comprising a linker between the RNA-guided endonuclease and the DNA polymerase.

Aspect 75. The fusion polypeptide of any one of aspects 64-74, wherein the DNA polymerase is a high-fidelity DNA polymerase.

Aspect 76. The fusion polypeptide of any one of aspects 64-75, wherein the fusion polypeptide further comprises a uracil glycosylase inhibitor (UGI).

Aspect 77. A system comprising: a) the fusion polypeptide of any one of aspects 64-76; and b) a guide RNA that comprises: i) a protein-binding segment comprising a nucleotide sequence that binds to the RNA-guided endonuclease; and ii) a target-binding segment comprising a nucleotide sequence that is complementary to a target nucleotide sequence in a target nucleic acid.

Aspect 78. The system of aspect 77, wherein the guide RNA is a single-molecule guide RNA.

Aspect 79. The system of aspect 77, wherein the guide RNA is a dual-molecule guide RNA.

Aspect 80. The system of any one of aspects 77-79, wherein the guide RNA comprises one or more of: a) a modified base; b) a modified backbone; c) a modified sugar moiety; and d) a non-natural internucleoside linkage.

Aspect 81. A method of editing a target nucleotide sequence in a target nucleic acid, the method comprising contacting the target nucleotide sequence with the system of any one of aspects 77-80.

Aspect 82. A nucleic acid comprising a nucleotide sequence encoding the fusion polypeptide of any one of aspects 64-76.

Aspect 83. A recombinant expression vector comprising the nucleic acid of aspect 82.

Aspect 84. A cell comprising the nucleic acid of aspect 82 or the recombinant expression vector of aspect 83.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or see, second(s); min, minute(s); h or hr, hour(s); aa, amino acid(s); kb, kilobase(s); bp, base pair(s); nt, nucleotide(s); i.m., intramuscular (ly); i.p., intraperitoneal (ly); s.c., subcutaneous (ly); and the like.

Example 1

A schematic depiction of a mutagenesis tool of the present disclosure is provided in FIG. 1. A fusion polypeptide comprising an error-prone nick-translating DNApol and a variant of Cas9 that nicks its target sequence (nCas9) is depicted in FIG. 1. The specificity of the polymerase initiation site created by the nCas9 offers single-base resolution for the start site of the editing window while the mutagenesis window length, mutation rate, and substitution bias are controlled by the polymerase processivity, fidelity, and misincorporation bias, characteristics chosen through polymerase variant selection. Because this genetic device will not rely on host machinery for the mutagenesis, it is readily adaptable to any transformation-competent organism. This mutagenesis tool is termed "EvolvR", reflecting how evolution often begins with replicative errors.

FIG. 1. Fusion of DNApol to nCas9 for targeted mutagenesis. A nicking Cas9 (nCas9) fused to an error prone DNA polymerase is targeted to the region to be mutated with an sgRNA. After the nCas9 makes a single stranded break, the polymerase binds to the nick, and synthesizes a new strand with low fidelity while displacing and degrading the original strand.

Mutator designs are tested for their ability to mutagenize target loci through fluctuation analysis, which determines mutation rates from the rate of reversing a nonsense mutation in an antibiotic resistance gene. In this assay, depicted schematically in FIG. 2A, a plasmid expressing the EvolvR components (pMut) is cotransformed into *E. coli* with a plasmid containing a nonfunctional antibiotic resistance gene (pNARG) containing a disabling nonsense mutation. After sixteen hours of growth without the antibiotic, the cultures are plated on the antibiotic and the mutation rates are determined by applying the Ma-Sandri-Sarkar statistical analysis to the colony counts.

Preliminary fluctuation analysis estimated the mutation rate of wild-type *E. coli* to be approximately $10^{-10}$ mutations per nucleotide per generation, which is similar to a previously reported $5.4 \times 10^{-10}$. The first mutator architecture tested was a translational fusion of nCas9 and the most well characterized nick-translating DNA polymerase, *E. coli* DNA polymerase I, with three fidelity-reducing mutations (PolI3M). These mutations include D424A, which inactivates proofreading activity, I709N, which is thought to enlarge the substrate-binding pocket by disrupting the hydrophobic pocket, and A759R, which is thought to stabilize the polymerase's closed conformation promoting translocation after a misincorporation. Combining these mutations results in a polymerase that has a reported mutation rate of approximately $8.1 \times 10^{-4}$ mutations per nucleotide.

To control for changes in global mutation rate that occur as a result of expressing an error-prone polymerase in the cell, the rate of non-specific mutation accumulation will be determined by measuring the antibiotic-resistance reversion rate of cells carrying a pMut plasmid targeting the (fitness-neutral) dbpA gene in the *E. coli* genome. The targeted mutation rate will be determined with an sgRNA nicking 11 bases 5' of the nonsense mutation. FIG. 2B shows that nCas9 alone has no difference in global and targeted mutation rate. Expressing nCas9 and PolI3M as separate proteins elevated the global mutation rate ~100 fold and the targeted mutation rate ~1,000 fold. An N-terminally fused PolI3M maintains the ~100 fold increase in global mutation rate but provides a greater than 10,000 fold increase of mutation rate over wild-type at the targeted locus.

To promote the unbinding of the nuclease after cleavage, it was hypothesized that DNA residence time could be reduced by introducing a set of mutations into the fused nCas9 that are suggested to lower Cas9's non-specific DNA affinity. Using this mutant nCas9 (enCas9) increased the global mutation rate 1.9 fold while the targeted mutation rate increased 8.6 fold compared to nCas9.

Figure 2A:
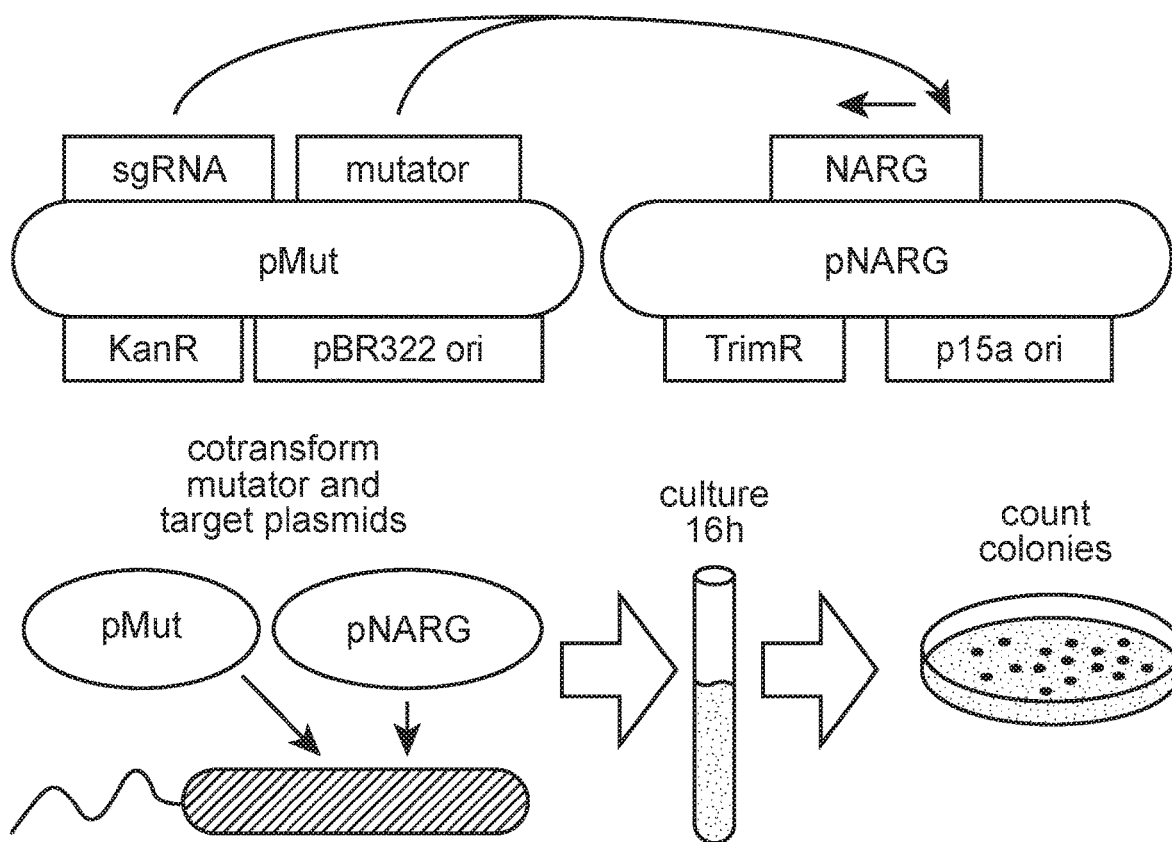
FIG. 2A-2C depict mutator designs (FIG. 2A), and mutational analysis of various mutators (FIGS. 2B and 2C).
Figure 2B:
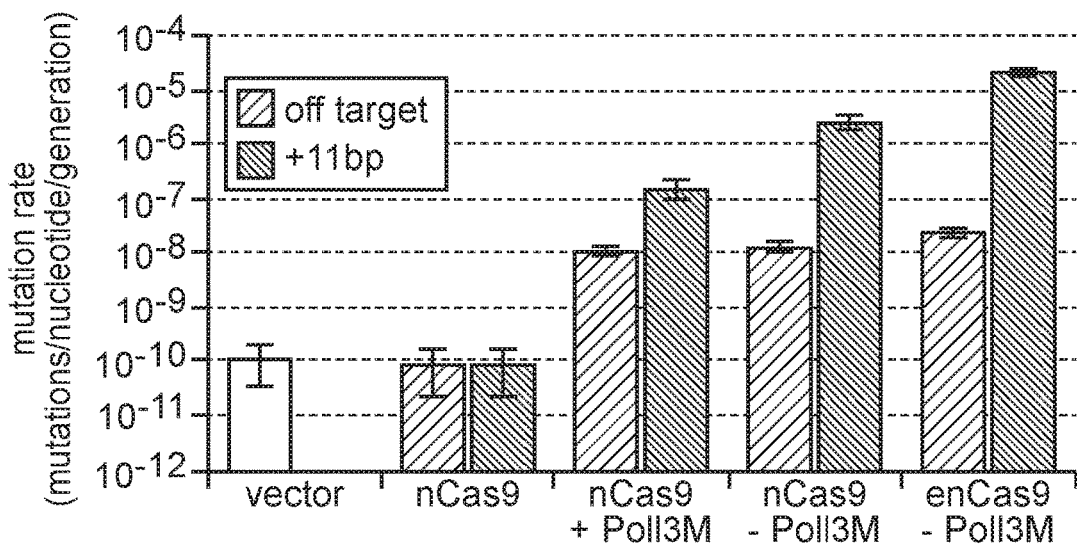
Figure 2C:
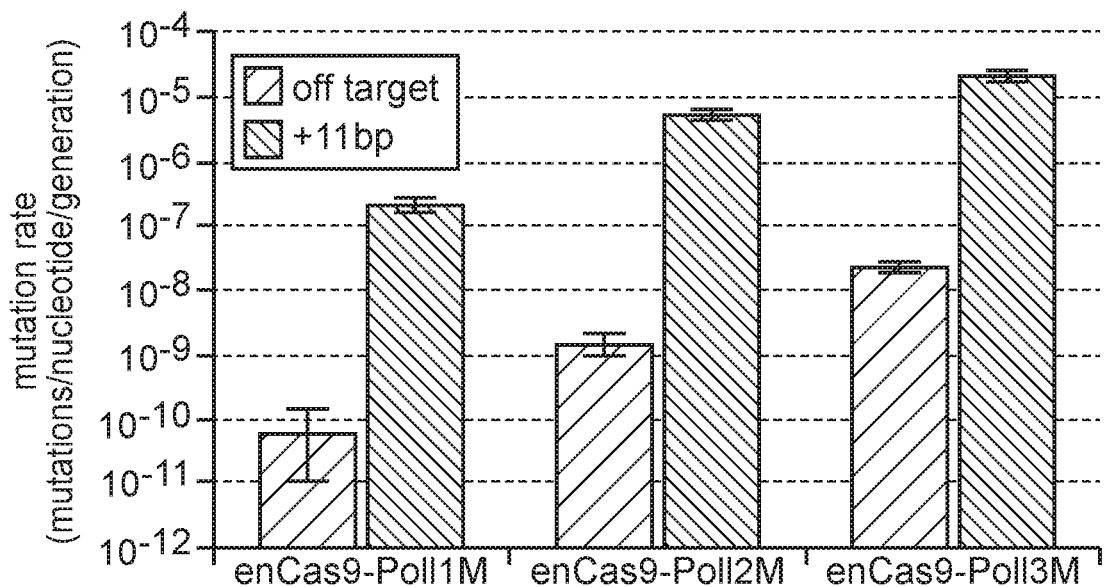

FIG. 2C shows that the fidelity of the DNApol confers the targeted and global mutation rate. PolI with a D424A mutation (PolIIM) was less mutagenic than PolI with both D424A and I709N mutations (PolI3M). PolI3M was the most mutagenic.

FIG. 2A-2C. A fluctuation analysis using different mutator architectures will determine targetability of mutagenesis, a) A fluctuation analysis will determine mutation rates by cotransforming *E. coli* with a plasmid coding the mutator architecture (pMut) and a plasmid containing an antibiotic resistance gene with a nonsense mutation (pNARG) and counting resistant colonies after 16 hours of growth. b) A fluctuation analysis showed that nCas9 and PolI3M-nCas9 do not increase the global or targeted mutation rate, as determined by an off target sgRNA and sgRNA nicking 11 nucleotides 5' of the nonsense mutation, respectively. nCas9-PolI3M increased the global mutation rate 100 fold and increased the targeted mutation rate 10,000 fold. Replacing nCas9 with a variant proposed to have lower affinity for DNA (enCas9) increased the targeted mutation rate 8.6 fold while the global mutation rate increased 1.9 fold. c) enCas9 fused to PolI with a D424A mutation (PolIIM) was less mutagenic that enCas9 fused to PolI with D424A and 1709 mutations (PolI2M). enCas9 fused to PolI3M was that most mutagenic.

Figure 3:
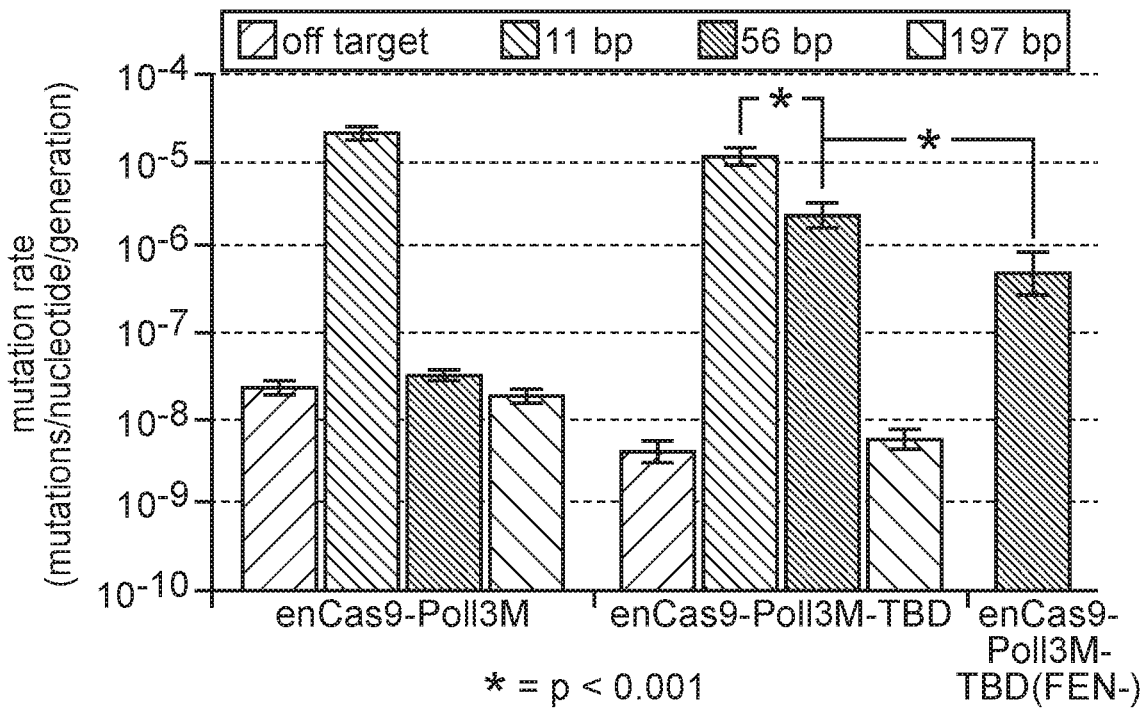
FIG. 3 depicts the mutagenesis window length of various mutators.

The mutagenesis window length can be determined with a fluctuation analysis using sgRNAs targeting different distances from the antibiotic resistance gene's nonsense mutation. To test whether the mutagenesis window length is determined by the processivity of the polymerase, PolI with T7 DNA polymerase's thioredoxin binding domain (PolI-TBD) was tested. This chimera has previously been shown to have higher processivity than PolI. Indeed, FIG. 3 shows that while PolI does not show any increase in mutagenesis over background when targeted 56 nucleotides from the nonsense mutation, PolI-TBD does. This suggests that the mutagenesis window length can be tuned by modifying the polymerase's processivity. It was found that a mutation that abolishes the flap endonuclease activity only slightly decreases the mutation rate. This suggests that DNA polymerases without flap endonuclease activity can be used, likely relying on endogenous single stranded exonucleases for degrading the displaced strand.

FIG. 3. Mutagenesis window length can be tuned by changing polymerase processivity, enCas9-PolI3M has a mutagenesis window length between 11 and 56 nucleotides. enCas9-PolI3M-TBD has a mutagenesis window length between 56 and 197 nucleotides. Inactivating flap endonuclease activity slightly decreases targeted mutation rate.

Figure 4A:
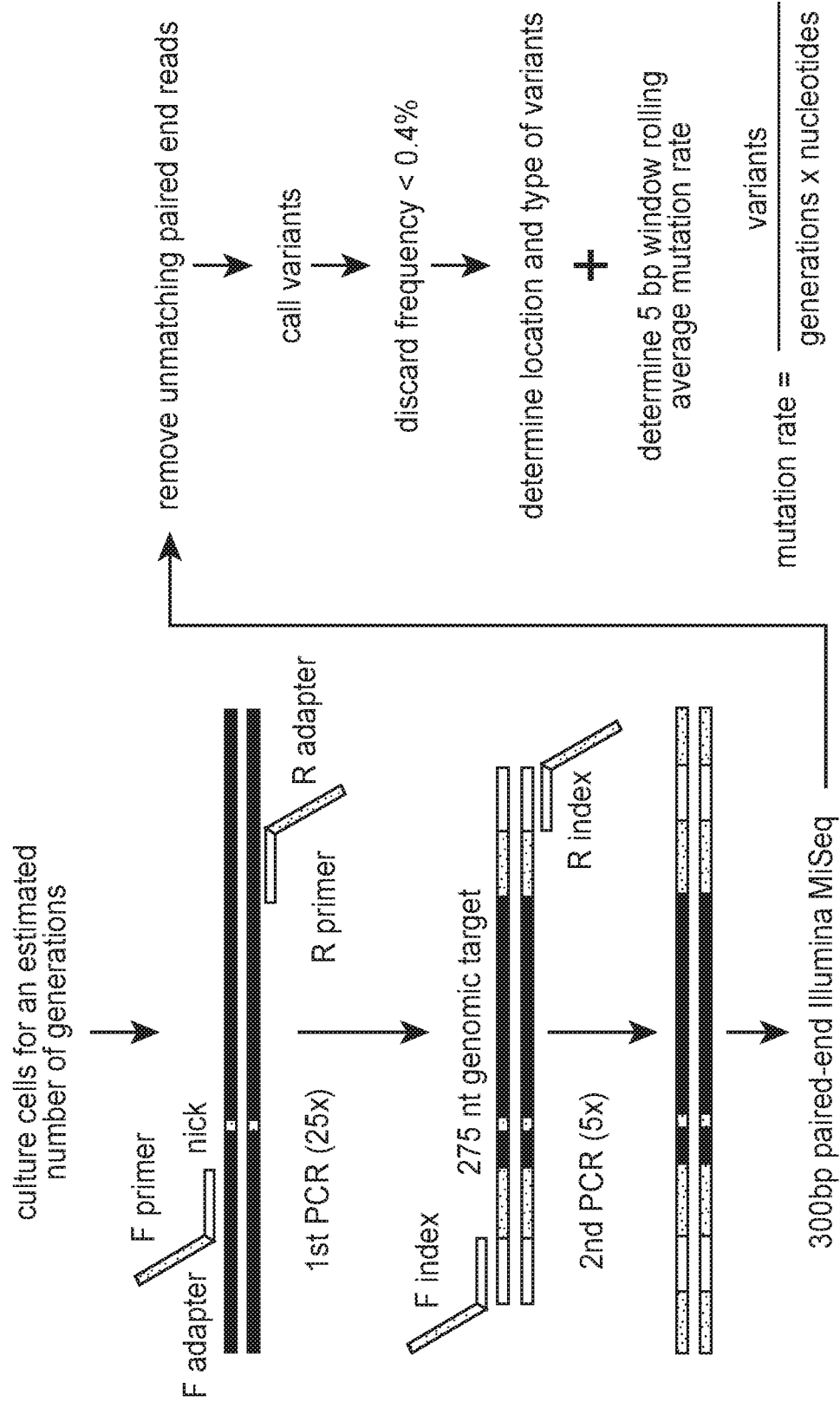
FIG. 4A-4B depict characterization of the mutation rate, substitution bias, and mutagenesis window length in bacterial, fungal, and mammalian cells.

As shown in FIG. 4A, cells are transformed with EvolvR constructs targeted to a neutral genomic locus. The number of cell generations is estimated by quantifying the viable cell count before and after the growth period. The genomic target is amplified from purified genomes using polymerase chain reaction (PCR) primers that simultaneously add Illumina adapters. A second round of PCR add indexes to de-multiplex pooled sequence runs. The samples are then analyzed with 300-base pair paired-end sequencing on an Illumina MiSeq.

FIG. 4A. Targeted amplification of genomic loci targeted with a mutator for a certain number of generations is sequenced with 300-bp completely overlapping paired-end sequencing with an Illumina MiSeq. Unmatching paired reads and low frequency variants are discarded. The variants are used to determine the distribution of types of substitution as well as the mutagenesis window length.

Figure 4B:
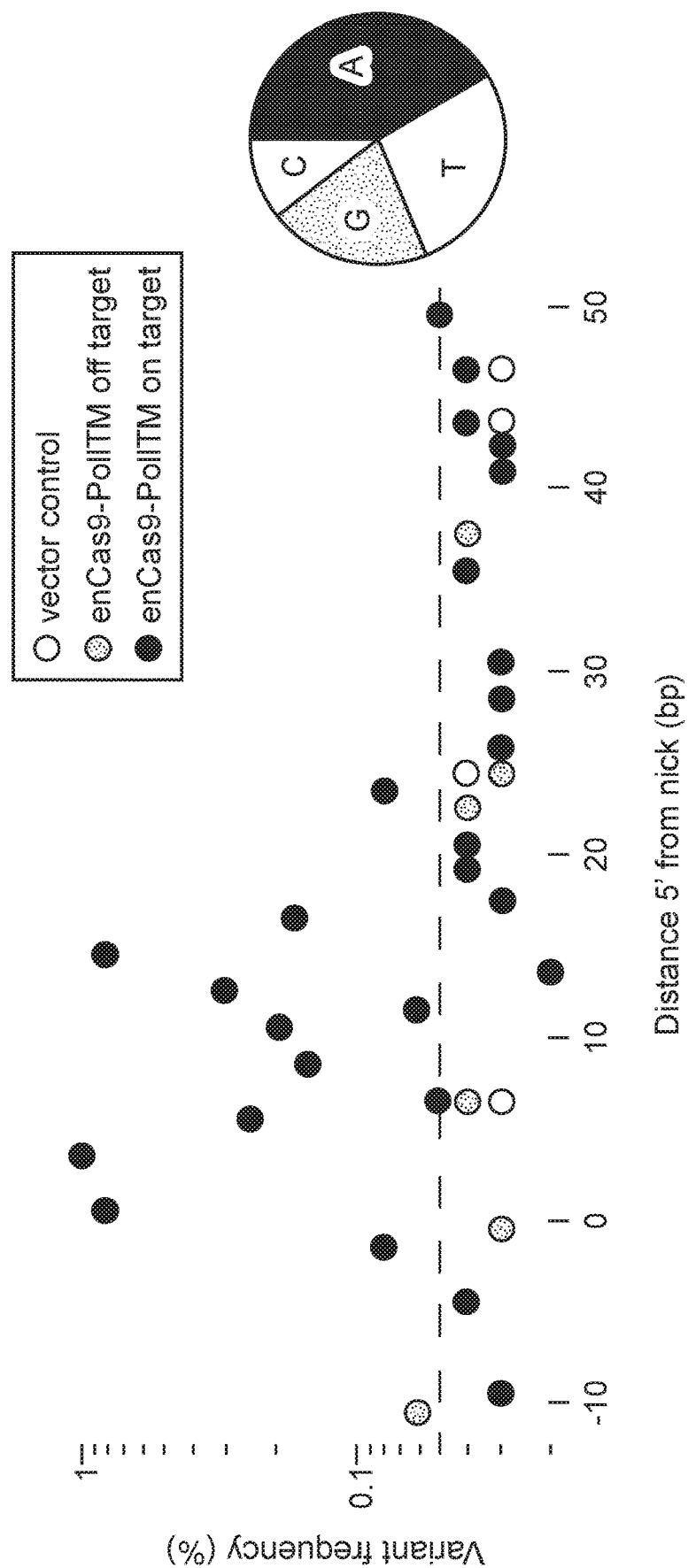

High throughput sequencing is used to characterize the mutation rate, frequency of each type of nucleotide substitution and mutagenesis window length of the optimal architecture and polymerase combinations. The target region is amplified from purified genomes using PCR primers that simultaneously add Illumina adapters. A second round of PCR adds indexes to de-multiplex pooled sequencing runs. The samples are then analyzed with 300 base pair paired-end sequencing on an Illumina MiSeq. To prevent sequencing errors contributing false positive mutational events to the analysis, the paired-end reads is compared to each other and any unidentical pairs are discarded. After aligning to a reference, VarScan2 is used to call the variants. Any variant represented by more than 0.4% of the total reads is considered a true mutational event. The mutations identified are used to quantify the relative frequency of the 12 types of substitutions and will determine a 5 bp window rolling average mutation rate. FIG. 4B shows that variants can be captured at a frequency greater than 0.4% within a window of twenty nucleotides 3' of the nick using the enCas9-PolI3M construct and that all four nucleotides were substituted.

FIG. 4B. (left panel) Frequency of single nucleotide variants after 24 hours of growth ("on"=sgRNA causing nicking at position 0; "off"=sgRNA targeting dbpA, a safespot in the genome; "vector"=empty plasmid without enCas9-PolI™ construct). (right panel) Distribution of point mutants' original nucleotide identity.

Example 2

EvolvR, a system that can continuously diversify all nucleotides within a tunable window length at user-defined loci was developed. This was achieved by directly generating mutations using engineered DNA polymerases targeted to desired loci via CRISPR-guided nickases. Nickase and polymerase variants that offer a range of targeted mutation rates up to 7,770,000-fold greater than wild type cells, and editing window lengths up to 350 nucleotides were identified. EvolvR was then used to identify novel ribosomal mutations that confer resistance to the antibiotic spectinomycin. The results demonstrate that CRISPR-guided DNA polymerases enable multiplexed and continuous diversification of user-defined genomic loci that will be useful for a broad range of basic and biotechnological applications.

Figure 22A:
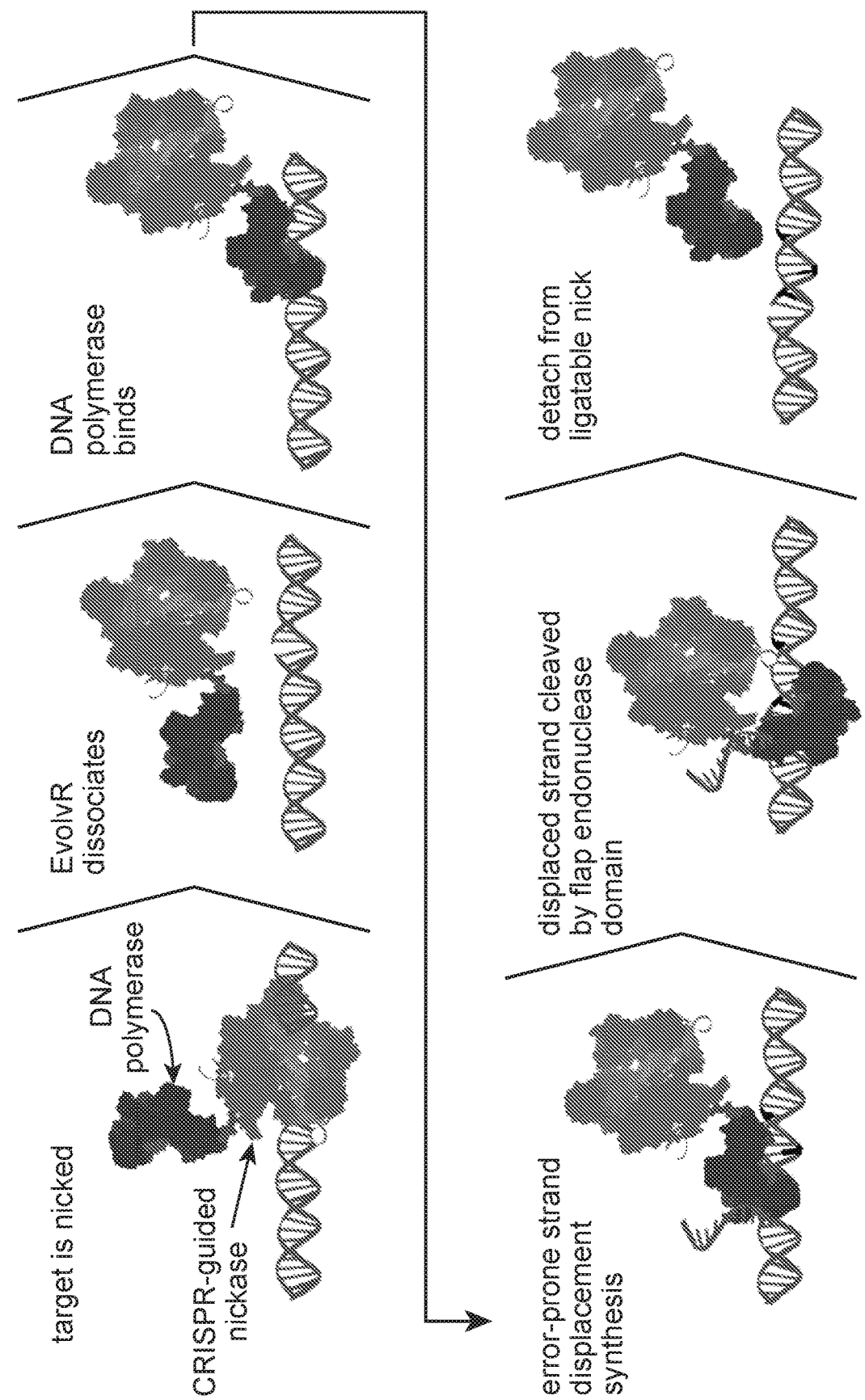
FIGS. 22A-22E provide a schematic of an example of a fusion polypeptide of the present disclosure, a characterization of substitution frequency, and analysis of mutation rates.
Figure 22B:
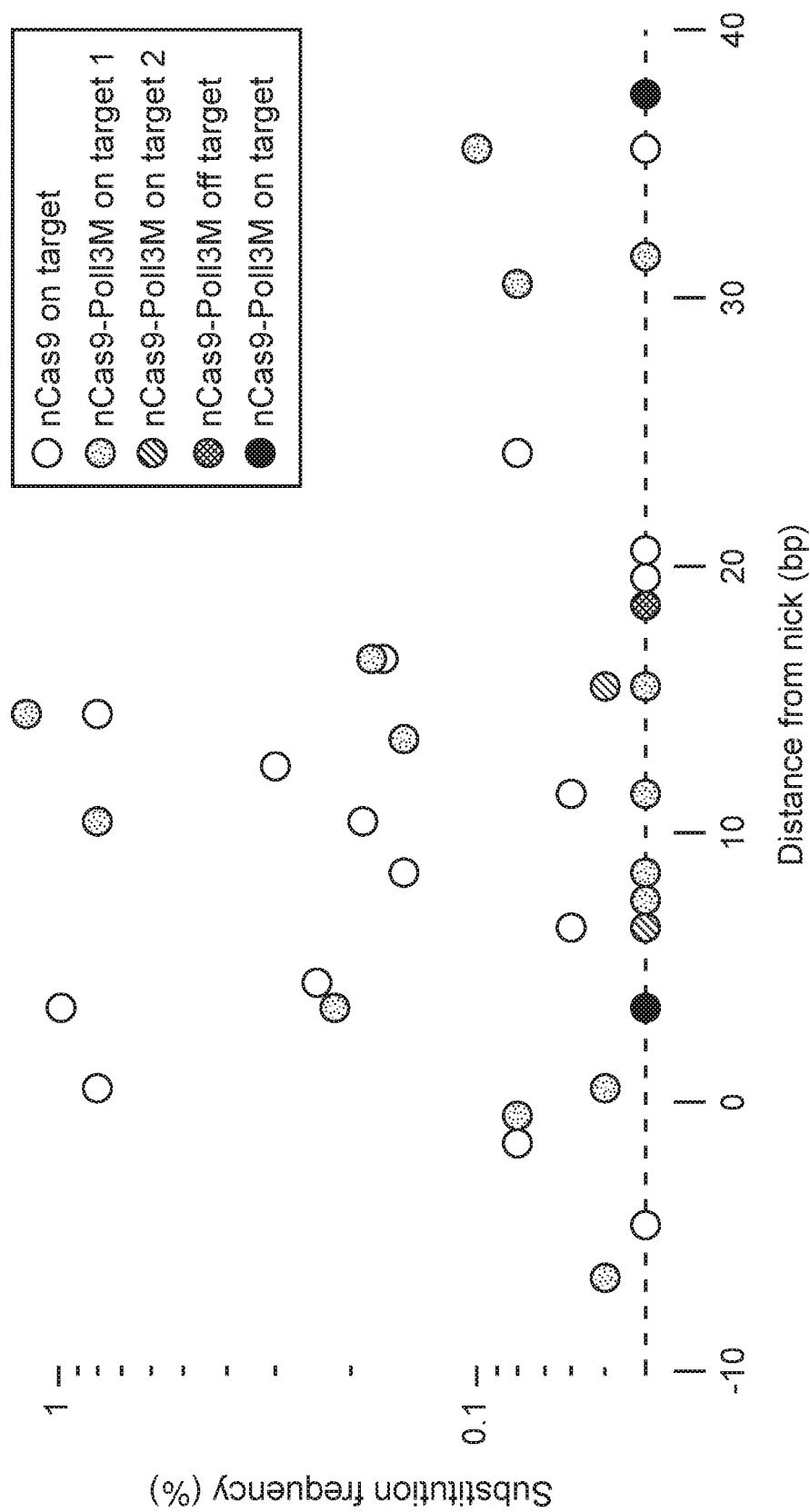

It was hypothesized that recruiting an error-prone, nick-translating DNA polymerase with a nicking variant of Cas9 (nCas9) could offer an ideal HDR-independent targeted mutagenesis tool, termed EvolvR (FIG. 22A). The specificity of the polymerase initiation site created by the nCas9 specifies the start site of the editing window, while the mutagenesis window length, mutation rate, and substitution bias are controlled by the polymerase variant's processivity, fidelity, and misincorporation bias, respectively.

FIG. 22A-22E| EvolvR (error-prone DNA polymerase fused to nicking Cas9) enables targeted mutagenesis. a, The EvolvR system consists of a CRISPR-guided nickase that nicks the target locus and a fused DNA polymerase which performs error-prone nick translation. b, High-throughput sequencing shows that fusing nicking Cas9 (nCas9) to E. coli DNA polymerase I with the fidelity-reducing mutations D424A, I709N, and A759R (PolI3M) resulted in substitutions in a ~17 nucleotide window 3' from the nick. Only data points above 0.04% frequency were considered true substitutions (dotted line; see Methods). Expressing nCas9 fused to PolI3M with an off-target guide yielded only one substitution and at low-frequency, while an unfused nCas9 and PolI3M did not show substitutions at a frequency above 0.04%. c, All four nucleotides were substituted by nCas9-PolI3M. d, Description of fluctuation analysis workflow used to sensitively quantify targeted and global mutation rates. e, The global and targeted mutation rates of wild-type E. coli, nCas9 fused to PolI3M, unfused nCas9 and PolI3M, PolI3M alone, and nCas9 alone were determined by fluctuation analysis. On-target gRNA yields nicks 11 nucleotides 5' of the nonsense mutation. Fluctuation analysis was performed with ten replicates of each group, and error bars represent the 95% confidence intervals.

Figure 22C:
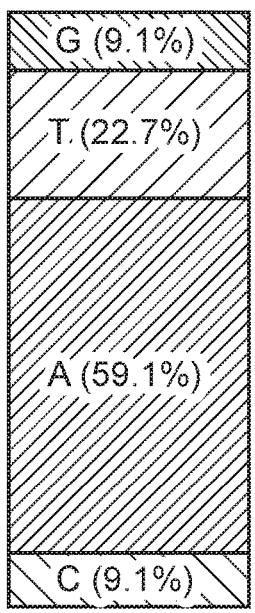

In the initial design, nCas9 (Streptococcus pyogenes Cas9 harboring a D10A mutation) was fused to the N-terminus of a fidelity-reduced variant of E. coli DNA polymerase I (PolI) harboring the mutations D424A, I709N, and A759R (PolI3M)[21]. A plasmid (pEvolvR) expressing the nCas9-PolI3M and a gRNA in E. coli was tested for its ability to mutate a second plasmid targeted by the gRNA over 24 hours of propagation. High-throughput targeted amplicon sequencing revealed that the target plasmid accrued substitutions in a ~17 nucleotide window 3' of the nick site (FIG. 22B), consistent with the established 15-20 nucleotide processivity of PolI[22]. The presence of low-frequency substitutions 5' of the nick site may be due to endogenous 3' to 5' exonucleases removing a few nucleotides 5' of the nick before the polymerase initiates synthesis. Critically, substitutions of all four nucleotide types were observed (FIG. 22C). In addition to substitutions, PolI is known to create deletions, which accounted for 25% of the observed variants in the 17 nucleotide window[23]. No insertions were detected. As controls, expressing nCas9-PolI3M with an off-target guide only showed one low-frequency substitution, while targeting pTarget with an unfused nCas9 and PolI3M, as well as nCas9 alone, did not show substitutions at a frequency greater than 0.04%.

Figure 22D:
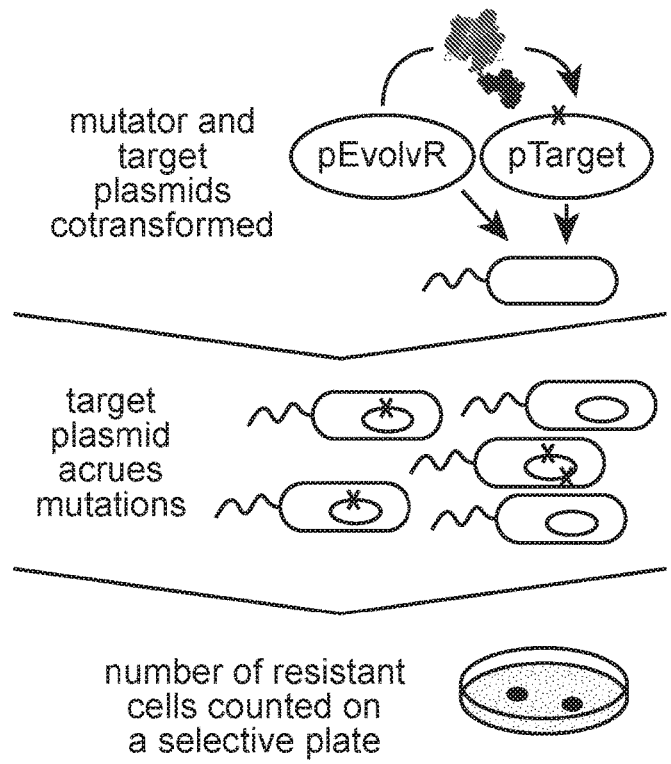
Figure 22E:
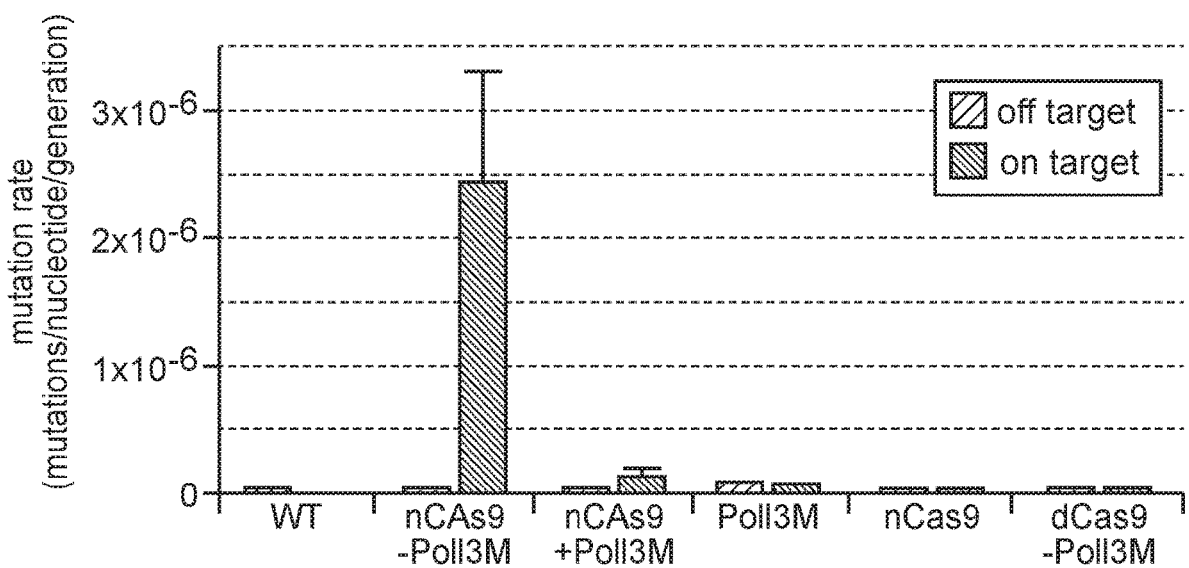
Figure 25:
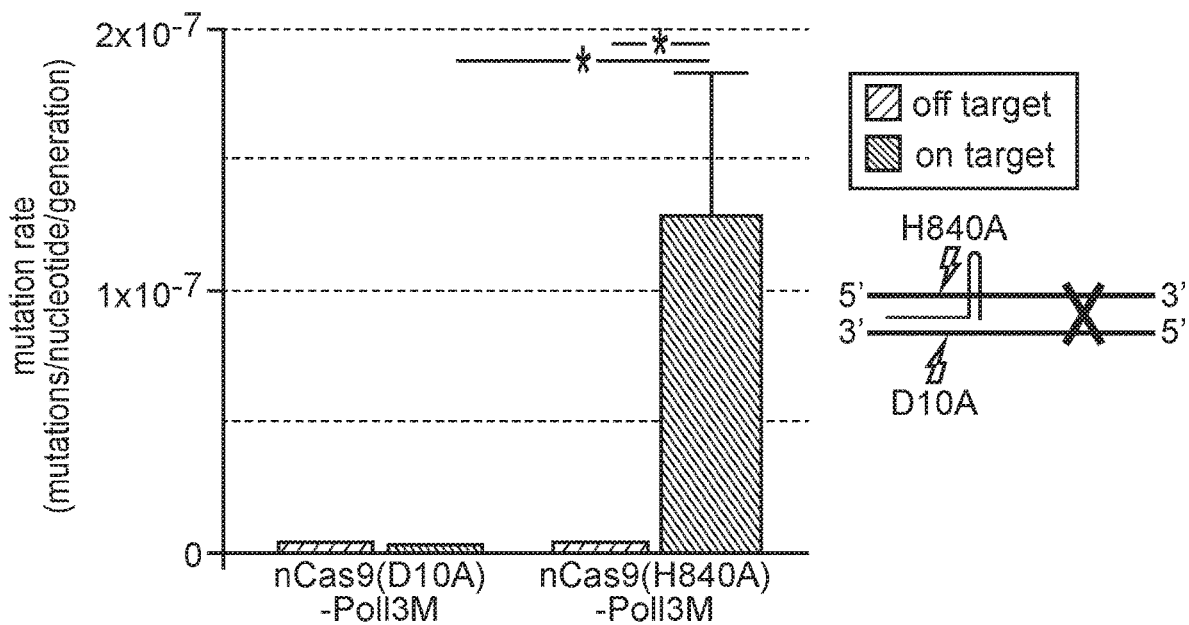
FIG. 25 provides an analysis of the direction of mutagenesis relative to a gRNA.

To sensitively quantify the mutation rate and mutagenesis window length of EvolvR variants, a fluctuation analysis was designed[24]. For this assay, the pEvolvR plasmid was cotransformed into E. coli with a plasmid (pTarget) containing the aadA spectinomycin resistance gene disabled by a nonsense mutation (FIG. 22D). After 16 hours of growth, the cultures were plated on spectinomycin and the mutation rates were determined from the number of resistant colony forming units (CFU). As shown in FIG. 22E, fluctuation analysis estimated the mutation rate of wild-type E. coli to be approximately $10^{-10}$ mutations per nucleotide per generation, similar to previously reported values[25]. The global mutation rate (the mutation rate of the untargeted genome in cells expressing EvolvR) was determined by measuring the spectinomycin-resistance reversion rate of cells carrying a gRNA targeting dbpA, a fitness-neutral RNA helicase gene in the E. coli genome[26]. The targeted mutation rate was determined with a gRNA nicking 11 nucleotides 5' of the nonsense mutation in pTarget. Expressing nCas9 fused to the N-terminus of PolI3M dramatically increased the mutation rate at the targeted locus 24,500-fold over wild type while increasing the global mutation rate 120-fold over wild type (FIG. 22E), a global mutation rate comparable to that of previous E. coli targeted mutagenesis techniques[1,27,28]. By comparison, expressing nCas9 and PolI3M as separate proteins, PolI3M alone, nCas9 alone, or catalytically inactive Cas9 (dCas9) fused to PolI3M, showed significantly lower targeted mutation rates (p<0.05 with a simple two-sided student's T test), suggesting that both PolI3M and the nick created by nCas9 are essential for EvolvR-mediated mutagenesis. Finally, by replacing the D10A nCas9, which nicks the strand complementary to the gRNA, with the H840A nickase, which nicks the strand non-complementary to the gRNA, it was found that the direction of EvolvR-mediated mutagenesis relative to the gRNA is dependent on which strand is nicked (FIG. 25).

FIG. 23A-23H| EvolvR provides tunable mutation rates and mutagenesis window lengths, combinatorial mutations, multiplexed targeting, and continuous diversification of genomic loci. a, Introducing mutations found to lower non-specific DNA affinity into the fused nCas9 (enCas9)[29] increased the global mutation rate 223-fold compared to the wild type mutation rate (1.9-fold greater than nCas9-PolI3M), while increasing the targeted mutation rate 212,038-fold above wild type (8.7-fold greater than nCas9-PolI3M). b, Mutagenesis rates were dependent on the fidelity of the polymerase. PolI with a D424A mutation (PolI1M) was less mutagenic than PolI with both D424A and I709N mutations (PolI2M), while PolI3M (D424A, I709N, A759R) was the most mutagenic. c, Screening mutations in PolI3M previously shown to decrease wild type PolI fidelity revealed that PolI3M with additional mutations F742Y and P796H (PolI5M) had a mutation rate 7,770,000-fold greater than wild type cells one nucleotide from the nick. Introduction of these mutations had no effect on the global mutation rate compared to PolI3M. Off-target mutation rates for the other variants were not measured. d, The editing window length was increased by incorporating the thioredoxin binding domain of bacteriophage T7 DNA polymerase into PolI3M (PolI3M-TBD). enCas9-PolI3M-TBD provided a targeted mutation rate 56 nucleotides from the nick that was 555-fold above the global mutation rate, while enCas9-PolI3M showed no targeted mutagenesis 56 nucleotides from the nick. e, enCas9-PolI3M-TBD targeted to a plasmid containing two nonsense mutations in the spectinomycin resistance gene (pTarget2) showed that EvolvR is able to generate combinations of multiple mutations. f, enCas9-PolI3M targeted to E. coli's endogenous genomic ribosomal protein subunit 5 gene, rpsE, generated 16,000-fold more spectinomycin resistant colony forming units (SpecR CFU) than when targeted to the dbpA locus. g, enCas9-PolI3M-TBD targeted to rpsL increased the rate of acquiring streptomycin resistance without increasing the rate of acquiring spectinomycin resistance. Coexpression of both rpsL and rpsE gRNA's increased both spectinomycin and streptomycin resistant CFUs. h, Cultures expressing enCas9-PolI3M-TBD and either the rpsL gRNA or both rpsE and rpsL gRNAs grew in streptomycin-supplemented media while cultures expressing an off-target gRNA or the rpsE gRNA did not. After back-dilution into spectinomycin- and streptomycin-supplemented media, only cultures expressing both rpsE and rpsL gRNAs grew. (For all figures, on-target gRNA nicked 11 nucleotides 5' of the nonsense mutation unless labeled otherwise. Ten replicates of each group were performed for bar and scatter plots; error bars indicate 95% confidence intervals for mutation rates and one standard deviation from the mean for SpecR CFU/viable CFU and OD 600 nm. "*" denotes p<0.05 with a simple two-sided student's T test).

Figure 23A:
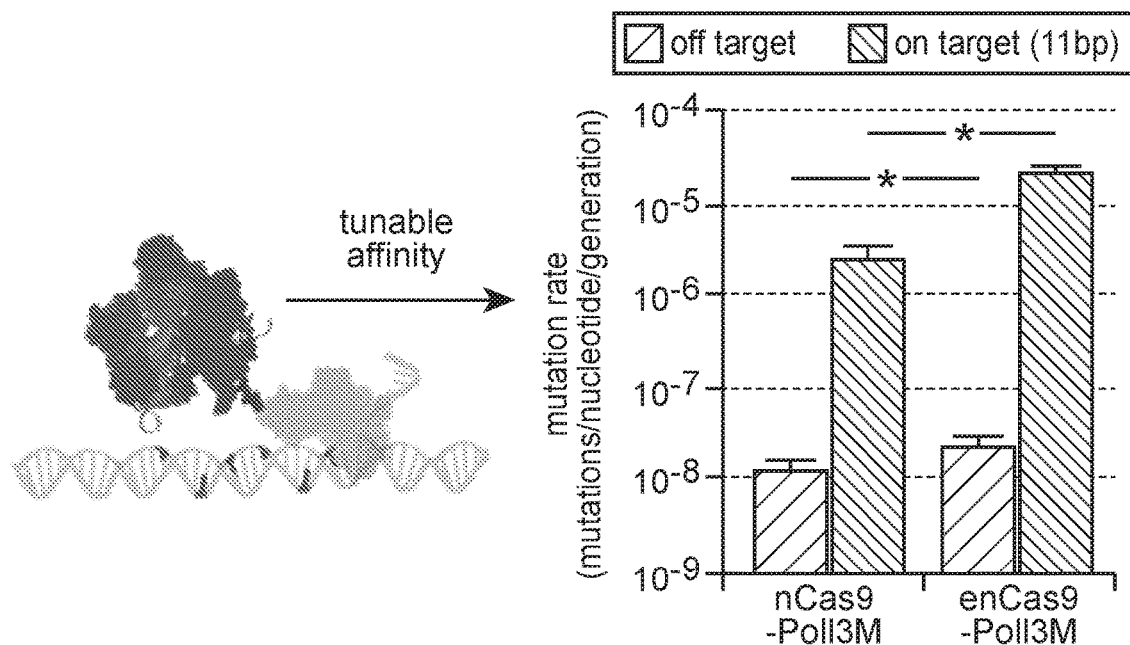

It was hypothesized that the targeted mutation rate could be further increased by promoting the dissociation of nCas9 from DNA after nicking the target locus. Therefore, a set of mutations (K848A, K1003A, R1060A) previously suggested to lower Cas9's non-specific DNA affinity[30] were introduced into the fused nCas9. The resulting enhanced nicking Cas9 (enCas9) fused to PolI3M increased the global mutation rate 223-fold compared to wild type cells (1.9-fold greater than nCas9-PolI3M), yet elevated the mutation rate at the targeted locus by 212,000-fold (8.7-fold greater than nCas9-PolI3M) (FIG. 23A).

Figure 23B:
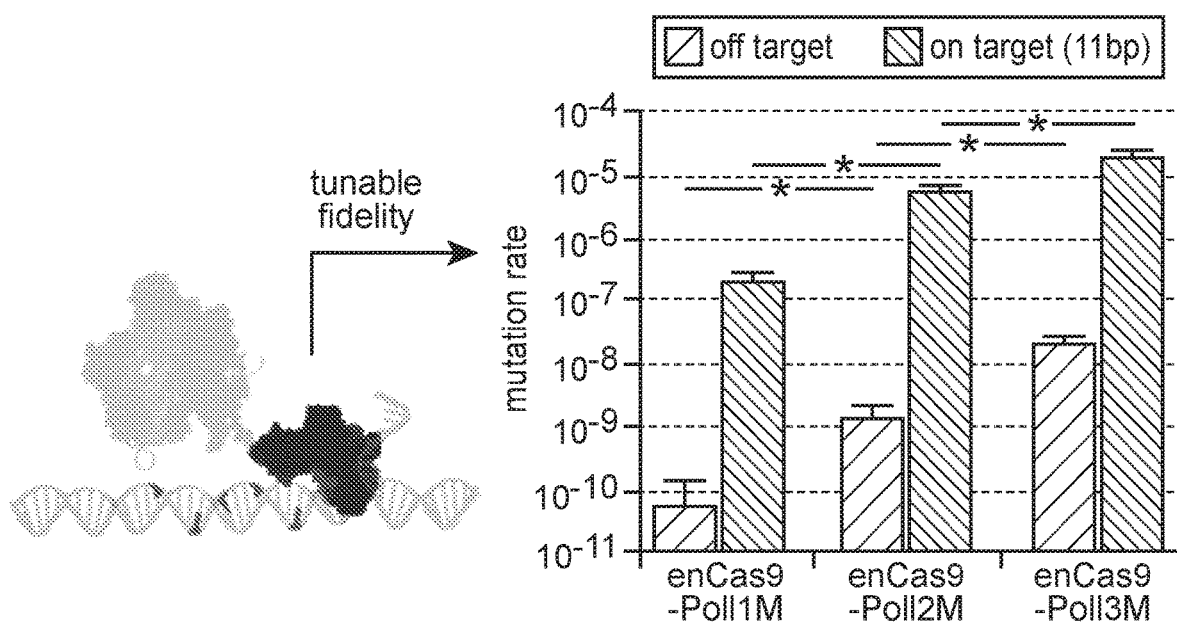
Figure 23C:
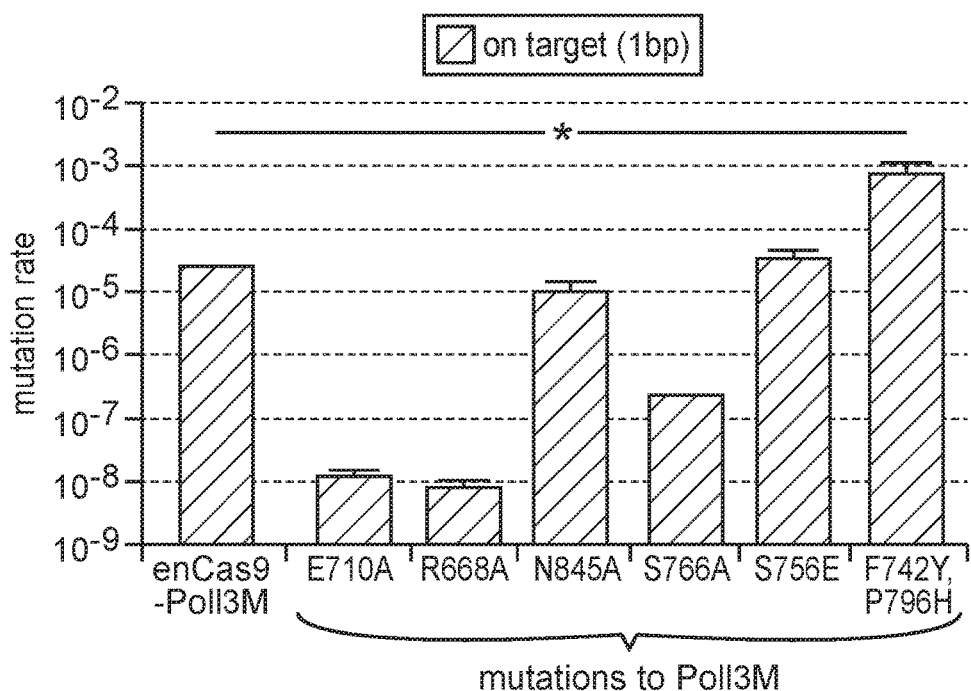
Figure 24A:
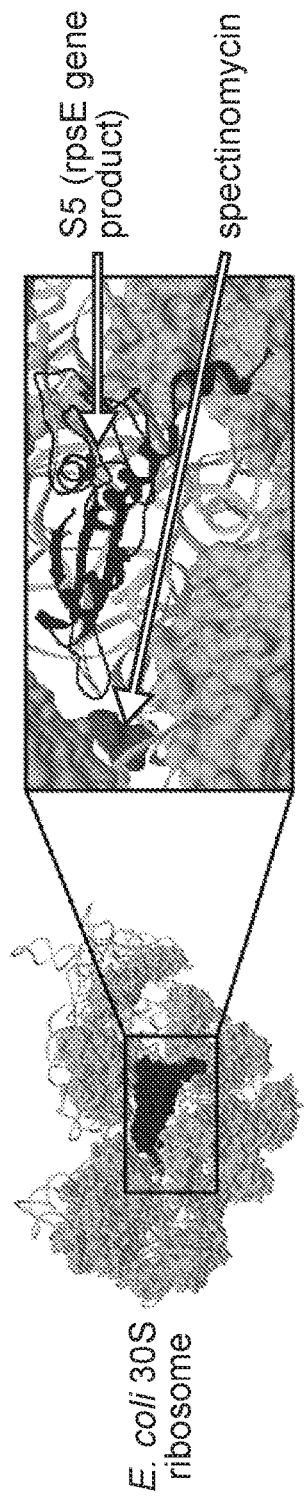
FIGS. 24A-24D provide characterization of mutations to *E. coli*'s Ribosomal Subunit 5 gene, rpsE, that confer spectinomycin resistance.
Figure 24C:
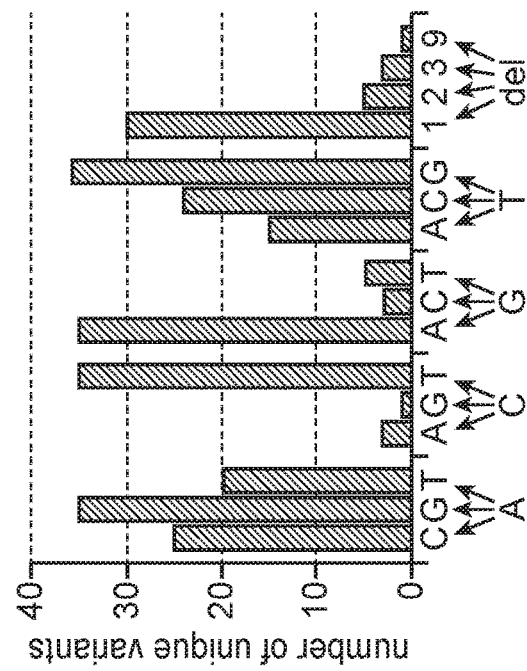
Figure 24B:
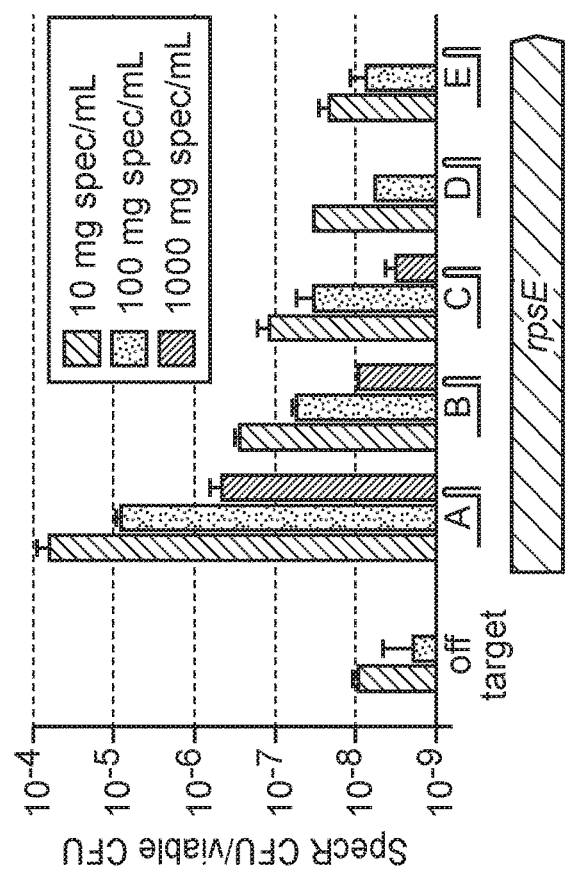
Figure 26:
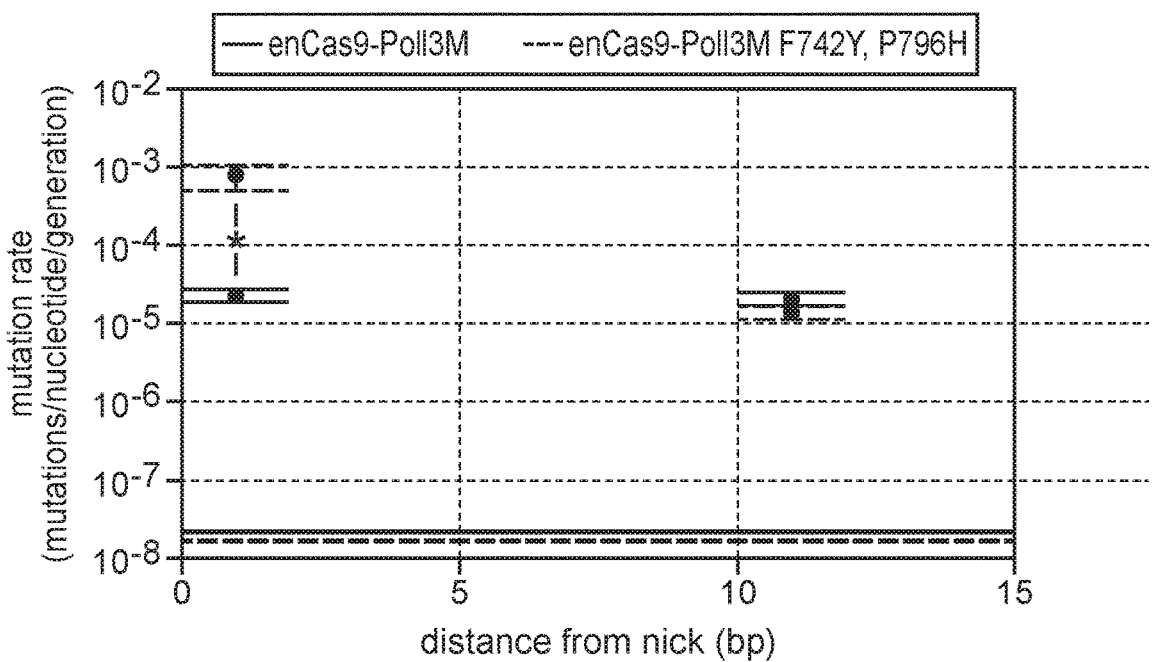
FIG. 26 provides a characterization of the mutation rate of various mutators at a distance from a nick.

PolI3M was initially chosen because it was the most error-prone variant of PolI previously characterized. However, it was hypothesized that the modularity of EvolvR would enable tuning of the mutation rate by using polymerases with different fidelities. First, it was confirmed that the fidelity of the polymerase determines mutation rates by comparing PolI variants, in decreasing order of fidelity: PolI1M (D424A), PolI2M (D424A, I709N), and PolI3M (D424A, I709N, A759R) (FIG. 23B). Next, to further increase EvolvR's targeted mutation rate, several additional mutations previously shown to individually decrease wild type PolI fidelity were screened[21,31,32] (FIG. 24C). PolI3M with the additional mutations F742Y and P796H (PolI5M) displayed a mutation rate one nucleotide from the nick 7,770,000-fold greater than wild type cells, and 33-fold higher than PolI3M, making it the most error-prone PolI mutant ever reported. Surprisingly, PolI5M did not exhibit a higher global rate of mutagenesis than PolI3M (FIG. 24B) and did not show higher mutation rates than PolI3M 11 nucleotides from the nick (FIG. 26).

Figure 27:
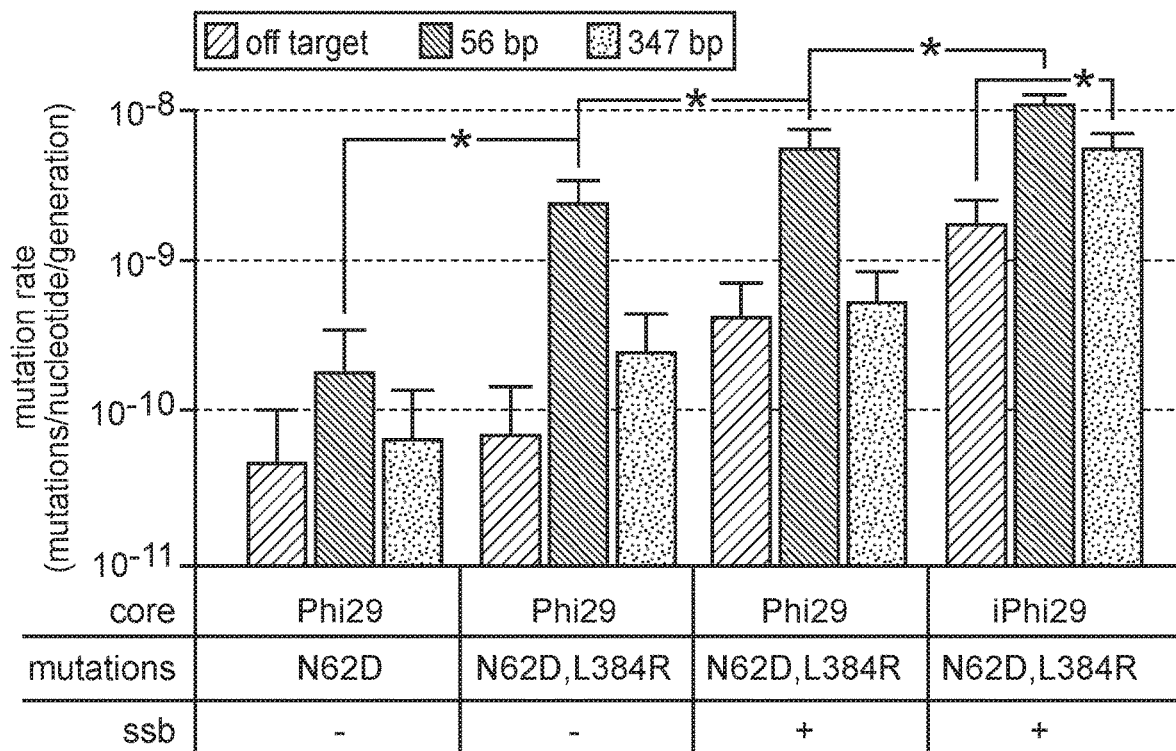
FIG. 27 provides a characterization of the target window length of a more processive DNA polymerase fused to enCas9.

It was hypothesized that using more processive DNA polymerases could increase the editing window length, so PolI5M was exchanged for the more processive bacteriophage Phi29 DNA polymerase (Phi29). Coexpression of gRNAs targeting different distances from the nonsense mutation, either wild type Phi29 or variants with previously reported fidelity-reducing and thermostabilizing mutations, and the Phi29 single-stranded binding protein led to targeted mutagenesis both 56 and 347 nucleotides from the nick site (FIG. 27). However, the mutation rate at these distances was not as high as what was achieved with PolI3M at shorter distances.

Figure 23D:
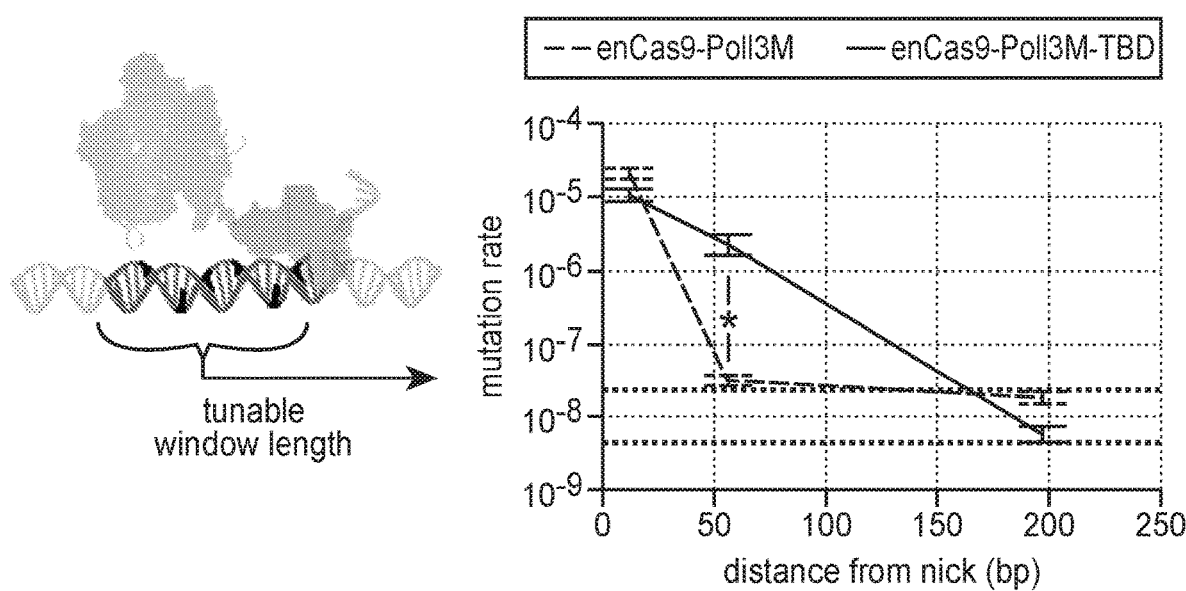

It was hypothesized that an alternative method to increase the editing window length while retaining high mutation rates would be to increase the processivity of PolI. Previous work has shown that fusing the thioredoxin binding domain (TBD) of bacteriophage T7 DNA polymerase increases PolI's processivity[34]. FIG. 23D shows that while the original enCas9-PolI3M did not show a difference between global and targeted mutation rates 56 nucleotides from the nick, incorporation of the TBD into the PolI3M EvolvR gene (enCas9-PolI3M-TBD) produced a 555-fold increase over the global mutation rate at this range. To leverage this increased editing window length, enCas9-PolI3M-TBD was targeted to a plasmid (pTarget2) containing two nonsense mutations (11 and 37 nucleotides from the nick) in the antibiotic resistance gene, and EvolvR's ability to generate combinations of multiple mutations with a single gRNA was thereby shown (FIG. 23E).

Figure 28:
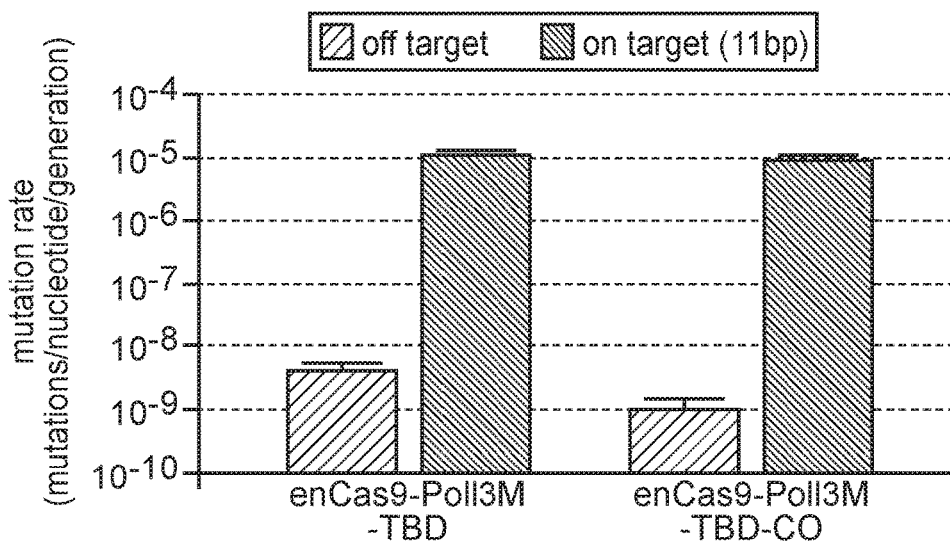
FIG. 28 provides the off-target mutation rate of various mutators.

It was hypothesized that unintended translation products consisting of functional DNA polymerase not fused to a functional CRISPR-guided protein contributed to undesirable off-target mutagenesis[35]. Therefore, the EvolvR coding sequence (enCas9-PolI3M-TBD-CO) was codon-optimized to remove three strong internal RBSs identified with the RBS Calculator[36]. The off-target mutation rate decreased 4.14-fold when expressing enCas9-PolI3M-TBD-CO compared to enCas9-PolI3M-TBD while the on-target mutation rate only decreased 1.23-fold (FIG. 28).

The ability to couple EvolvR-mediated mutagenesis to a non-selectable genetic screen would considerably broaden EvolvR's utility. It was found that after targeting EvolvR to a plasmid containing a GFP cassette with an early termination codon, 0.06% and 0.07% of the population was expressing GFP while no cells were expressing GFP using an off-target gRNA (FIG. 29). Importantly, EvolvR also showed the capacity to diversify chromosomal loci by increasing the fraction of the population resistant to spectinomycin 16,000-fold after targeting enCas9-PolI3M to E. coli's endogenous ribosomal protein subunit 5 gene, rpsE, which has mutations known to confer resistance to spectinomycin[37] (FIG. 23F).

Figure 30A:
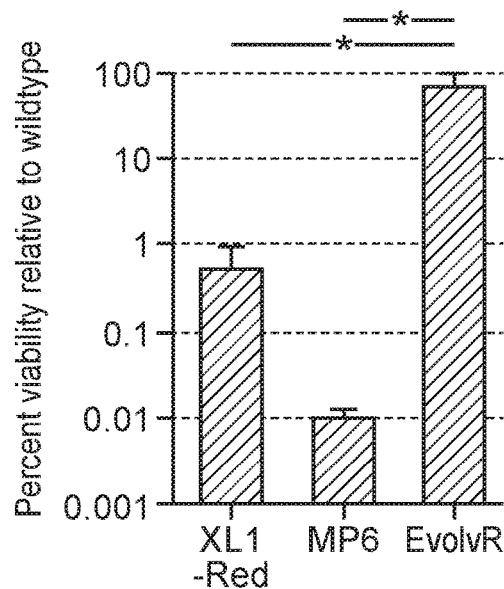
FIGS. 30A-30C illustrate the viability and growth rate of *E. coli* expressing examples of fusion polypeptides of the present disclosure.

Next, it was hypothesized that EvolvR avoids the cell-viability and evolutionary escape issues associated with non-targeted mutagenesis systems[38]. It was found that, unlike two previously developed non-targeted continuous mutagenesis systems, EvolvR does not impede cell viability or growth rate (FIGS. 30A and 30B). Additionally, targeting EvolvR to the rpsE gene evolved more spectinomycin resistant CFU's per mL compared to these previous E. coli non-targeted mutagenesis systems, even when normalized by optical density (FIG. 30).

Figure 23G:
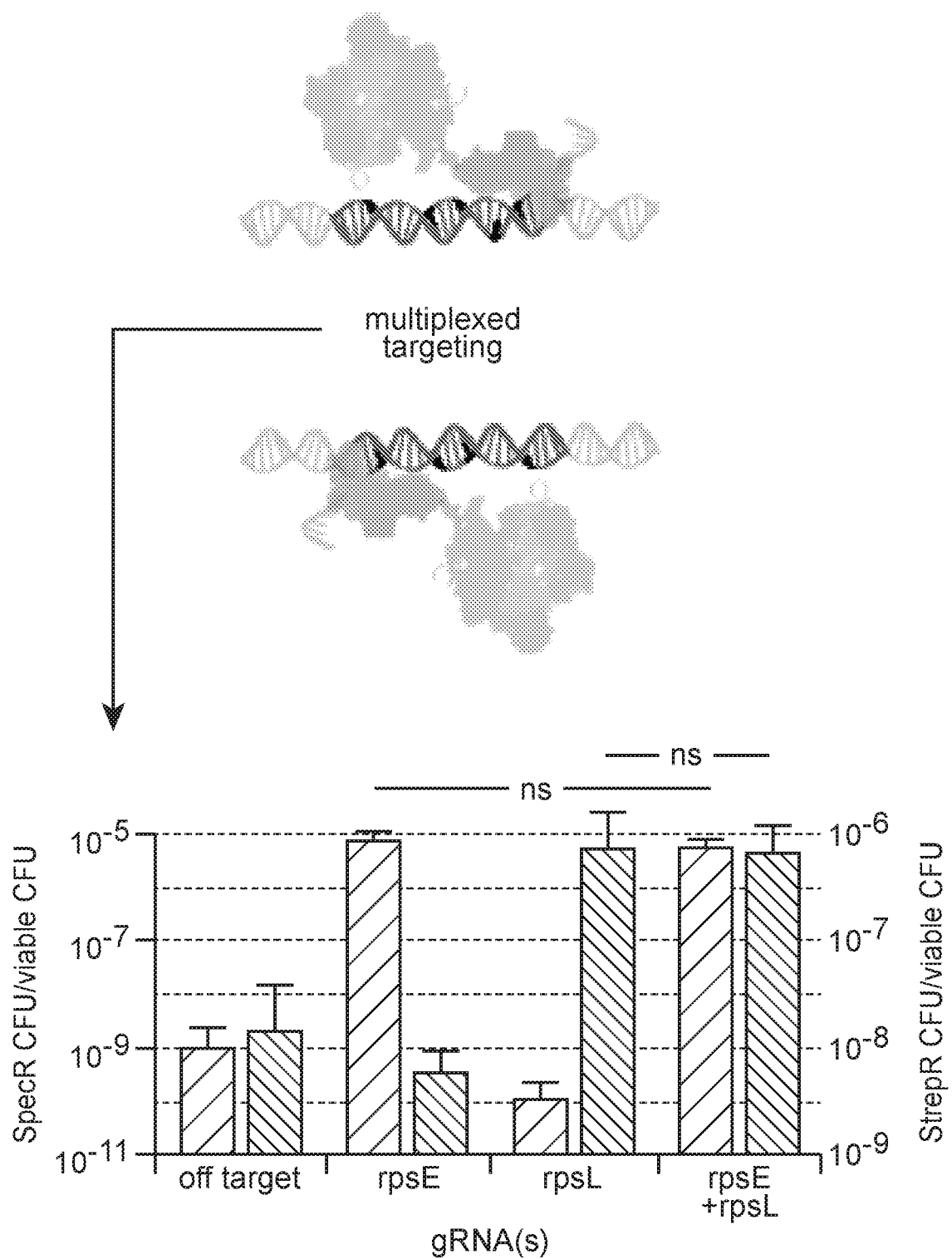

It was hypothesized that EvolvR could enable simultaneous diversification of distant genomic loci through coexpression of multiple gRNAs. First, expression of a gRNA targeting enCas9-PolI3M-TBD to rpsL, a ribosomal protein subunit gene with mutations known to confer streptomycin resistance[39], increased the rate of acquiring streptomycin resistance compared to wildtype cells, without increasing spectinomycin resistant CFUs (FIG. 23G). In comparison, coexpression of the gRNAs targeting rpsE and rpsL generated approximately the same number of spectinomycin and streptomycin resistant CFUs as expression of the rpsE gRNA or rpsL gRNA alone, respectively. This capacity to simultaneously diversify multiple loci will be useful for identifying epistatic interactions. Expression of two gRNA's that nick separate strands at genomic loci separated by 100 base-pairs was lethal, while nicking the same strand at the same distance was not lethal. Therefore, if multiple gRNAs were used to increase the length of the target region, targeting the same strand is suggested.

Figure 23H:
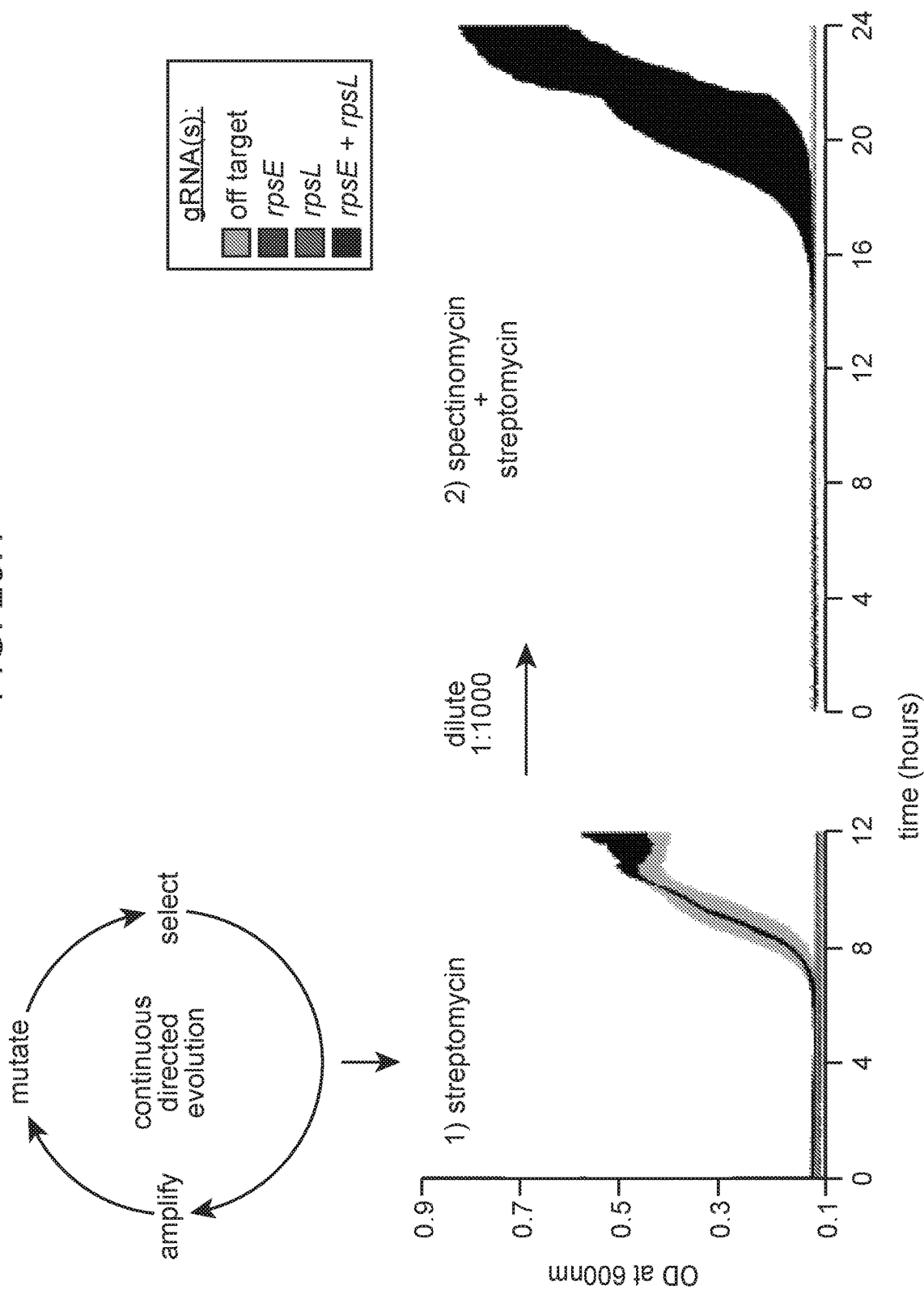

To evolve resistance to both spectinomycin and streptomycin, it was hypothesized that EvolvR's continuous diversity generation could be utilized for continuous directed evolution, in which mutagenesis, selection, and amplification occur simultaneously, to allow adaptation to modulated selection pressures with minimal researcher intervention. First, cultures expressing enCas9-PolI3M-TBD and either the rpsL gRNA or both rpsE and rpsL gRNAs grew in liquid media supplemented with streptomycin, whereas cultures expressing an off-target gRNA or the rpsE gRNA did not (FIG. 23H). After the cultures were diluted 1000-fold into liquid media supplemented with both spectinomycin and streptomycin, only cultures expressing both rpsE and rpsL gRNAs grew.

FIG. 24A-24D| EvolvR identified novel mutations to *E. coli*'s Ribosomal Subunit 5 gene, rpsE, that confer spectinomycin resistance. a, Spectinomycin inhibits protein synthesis through interactions with the 30S ribosome. b, enCas9-PolI3M-TBD targeted to different parts of the endogenous rpsE gene with five gRNAs showed higher rates of spectinomycin resistance than targeting dbpA (off-target). c, After selection, high-throughput sequencing of the resistant cells containing gRNA's A, B, and C revealed that all twelve types of substitutions as well as deletions (del) were generated. Error bars indicate one standard deviation from the mean. d, Five mutations not previously described as conferring spectinomycin resistance were regenerated in a new strain of *E. coli* (RE1000), and growth curves in varying concentrations of spectinomycin confirmed the mutations provide spectinomycin resistance. Shaded area represents+/−one standard deviation from the mean of three biological replicates.

Figure 24D:
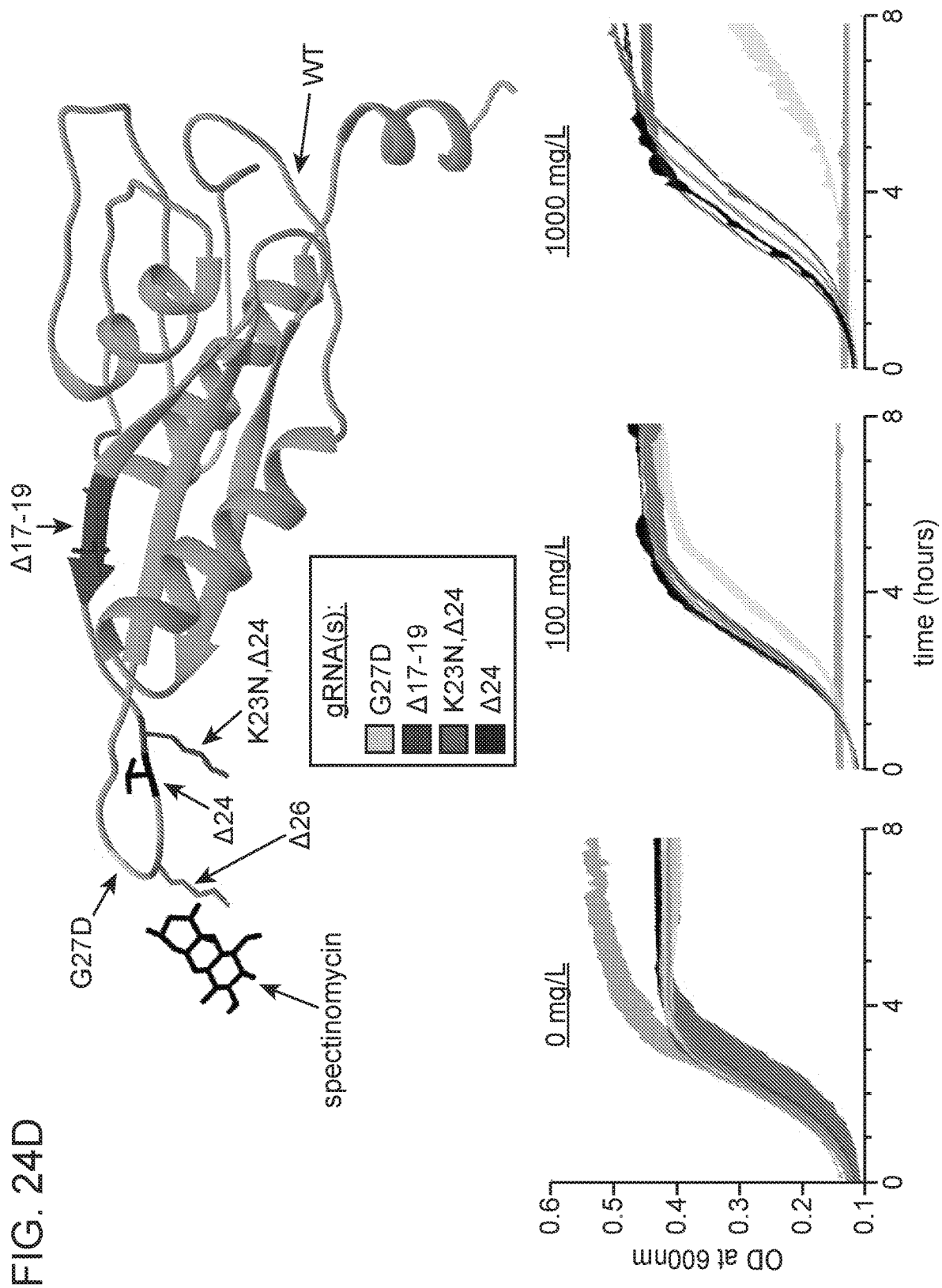
Figure 31:
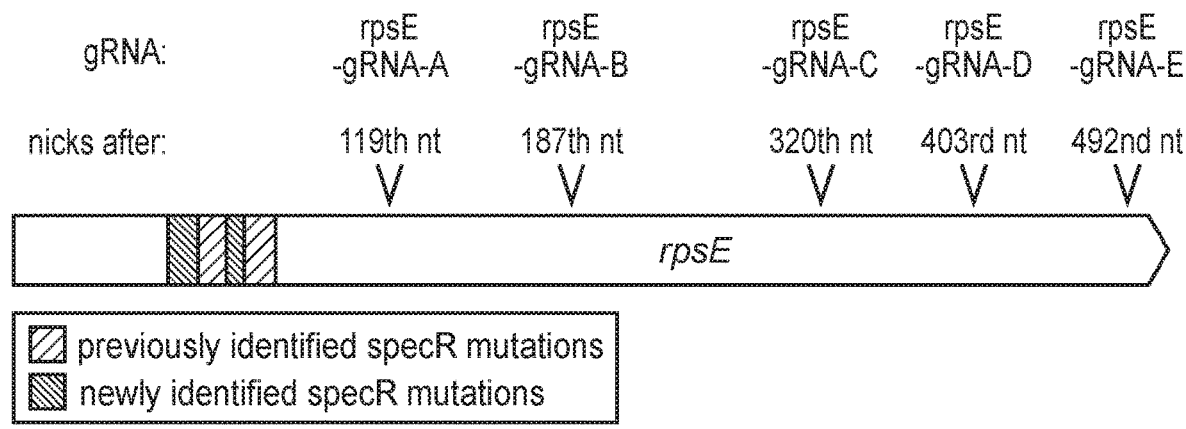
FIG. 31 illustrates locations of gRNA targets and mutations relative to the rpsE gene.

Spectinomycin's clinical utility as a broad-spectrum antibiotic has motivated previous efforts to characterize genomic mutations conferring spectinomycin resistance[40, 41]. EvolvR's capacity was used to diversify the genomic rpsE gene to identify novel mutations that confer spectinomycin resistance by disrupting the spectinomycin binding pocket of the 30S ribosome (FIG. 24A). First, enCas9-PolI3M-TBD was targeted to five dispersed loci in the endogenous rpsE gene using gRNA's that nick after the $119^{th}$, $187^{th}$, $320^{th}$, $403^{rd}$, or $492^{nd}$ base pair within the 504 base pair rpsE coding sequence (FIG. 31). Then, the cell populations were challenged for growth on agar plates supplemented with varying concentrations of spectinomycin and observed that resistance was highest with the gRNAs targeted to the domain of the ribosomal subunit protein proposed to interact with spectinomycin (FIG. 24). After selection, high-throughput sequencing of the resistant cells containing gRNA's A, B, and C revealed that all twelve types of substitutions, as well as deletions, were generated (FIG. 24C). For functional analysis, five of the candidate mutations not previously described as providing spectinomycin resistance were introduced into a different strain of *E. coli* (RE1000) using oligonucleotide-mediated recombination. Growth curves in varying concentrations of spectinomycin confirmed that each of the five mutations (Δ17-19; K23N, Δ24; Δ24; Δ26; G27D) provided varying levels of spectinomycin resistance, but reduced fitness in the absence of selection (FIG. 24D). Using these mutations, it was hypothesized that mutations that move Lys26 relative to the spectinomycin binding pocket confer resistance to spectinomycin by removing a hydrogen bond that stabilizes spectinomycin's interaction with the ribosome, which led to the discovery of more novel spectinomycin resistance-conferring mutations (FIG. 32). These mutations were accordingly submitted to the Antibiotic Resistance Genes Database[42]. This rapid method to determine genotypes conferring antibiotic resistance is generally useful for improving the effective use of antibiotics.

FIG. 25| The direction of EvolvR-mediated mutagenesis relative to the gRNA is dependent on which strand is nicked. The previous fluctuation analysis in FIG. 22E demonstrated that nCas9-PolI3M mutates a window 3' of the nick site. Here the study directly tested whether mutations are being generated 5' of the nick site using a different gRNA. Since DNA polymerases synthesize in the 5'-3' direction, it was hypothesized that nCas9-PolI3M would not provide an elevated mutation rate 5' of the nick site. The study indeed found that expressing a guide RNA which targeted nCas9 (D10A)-PolI3M to nick 16 nucleotides 3' from the nonsense mutation (red "x") did not show targeted mutagenesis. It was hypothesized that targeted mutagenesis could be induced using the same gRNA by using a Cas9 variant harboring the H840A mutation, which nicks the DNA strand non-complementary to the gRNA, rather than the D10A mutation, which nicks the strand complementary to the gRNA. It was found that nCas9 (H840A)-PolI3M increased the mutation rate 16 nucleotides 3' from the nick by 52 fold compared to the global mutation rate of cells expressing an off-target gRNA. The D10A nCas9 variant was used for all subsequent experiments. "*" denotes $p<0.05$ with a simple two-sided student's T test).

FIG. 26| PolI5M elevates mutation rate 1 but not 11 nucleotides from the nick compared to PolI3M. PolI3M with F742Y and P796H mutations (PolI5M) elevates the mutation rate 33 fold 1 nucleotide from the nick compared to PolI3M. PolI5M did not have a higher mutation rate than PolI3M 11 nucleotides from the nick. "*" denotes $p<0.05$ with a simple two-sided student's T test).

FIG. 27| Fusing a more processive DNA polymerase to enCas9 increases the target window length. PolI was exchanged for a more processive and higher fidelity bacteriophage Phi29 DNA polymerase (Phi29). Due to Phi29 not having a flap endonuclease, residues 1-325 of PolI were inserted between enCas9 and Phi29. Using gRNA's targeting different distances from the nonsense mutation, it was found that Phi29 with two previously reported fidelity-reducing mutations (N62D and L384R) elevated the mutation rate 56 nucleotides from the nick compared to the global mutation rate[33,48]. When Phi29's single-stranded binding protein (ssb), known to improve the activity of Phi29, was expressed, an elevation in targeted mutation rate was seen[49]. Finally, since the activity of Phi29 is known to decrease at temperatures above 30° C. and the fluctuation analysis was performed at 37° C., mutations previously reported to improve the thermostability of Phi29 (iPhi29) were added and a targeted mutation rate 347 nucleotides from the nick site that was significantly greater than the global mutation rate was observed[50]. Unfortunately, mutations decreasing Phi29's fidelity are known to decrease its processivity explaining the inability to identify Phi29 variants that retain high processivity while offering as high of a mutation rate as PolI3M[33]. (Ten replicates of each group; error bars indicate 95% confidence intervals for mutation rates; "*" denotes $p<0.05$ with a simple two-sided student's T test).

FIG. 28| Removing internal ribosome binding sequences decreases EvolvR-mediated off-target mutagenesis. enCas9-PolI3M-TBD-CO is enCas9-PolI3M-TBD that was codon optimized to remove strong ribosome binding sites in the EvolvR coding sequence predicted to produce an untethered DNA polymerase. The off-target mutation rate decreased 4.14-fold when expressing enCas9-PolI3M-TBD-CO compared to enCas9-PolI3M-TBD while the on-target mutation rate only decreased 1.23-fold.

Figure 29A:
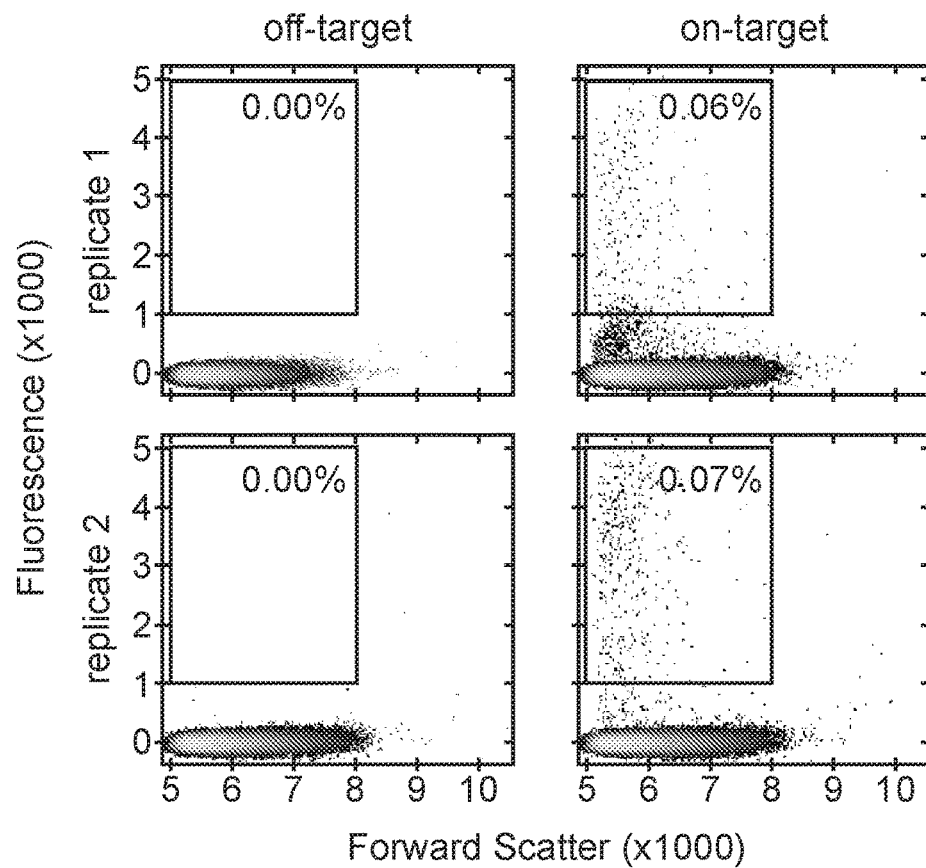
FIGS. 29A-29B illustrate coupling of mutagenesis by examples of fusion polypeptides of the present disclosure with a non-selectable genetic screen.
Figure 29B:
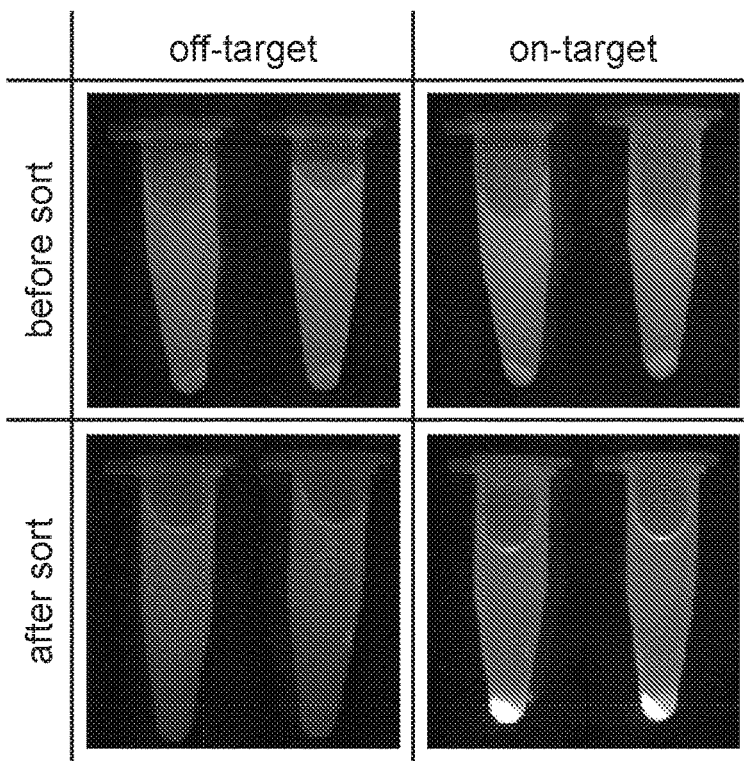

FIG. 29A-29B| EvolvR-mediated mutagenesis can be coupled with a non-selectable genetic screen. a, To test the capability for EvolvR-mediated mutagenesis to be coupled with a non-selectable genetic screen, a target plasmid containing a GFP cassette with an early termination codon in the GFP coding sequence (pTarget-GFP*) was designed. After cotransforming pEvolvR with pTarget-GFP* and growing for 24 hours, the GFP positive fraction was analyzed and sorted. In the two replicates expressing an off-target gRNA, no GFP cells were detected or sorted. In contrast, for the two replicates expressing a gRNA nicking four nucleotides away from the chain-terminating mutation in GFP's coding sequence, it was found that 0.06% and 0.07% of the total cells were GFP positive. These results agree with sequencing outcomes from FIG. 22B which showed that expressing nCas9-PolI3M for 24 hours produces substitutions in the target region at frequencies between 0.5% to 1%. b, After culturing the sorted populations, both replicates expressing an off-target gRNA did not show growth, while both replicates expressing the on-target gRNA grew bright green.

Figure 30C:
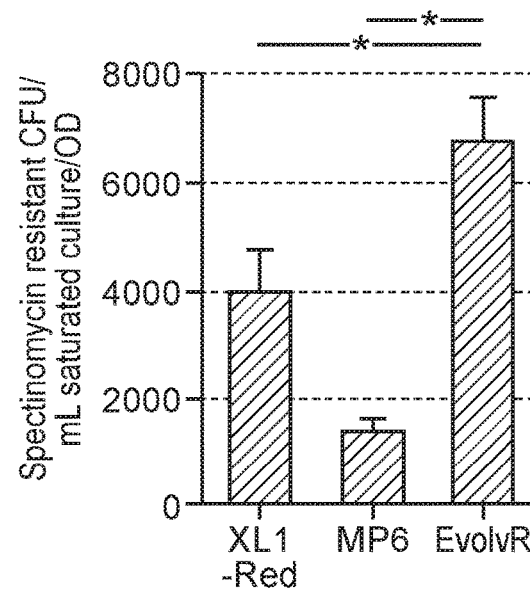
Figure 30B:
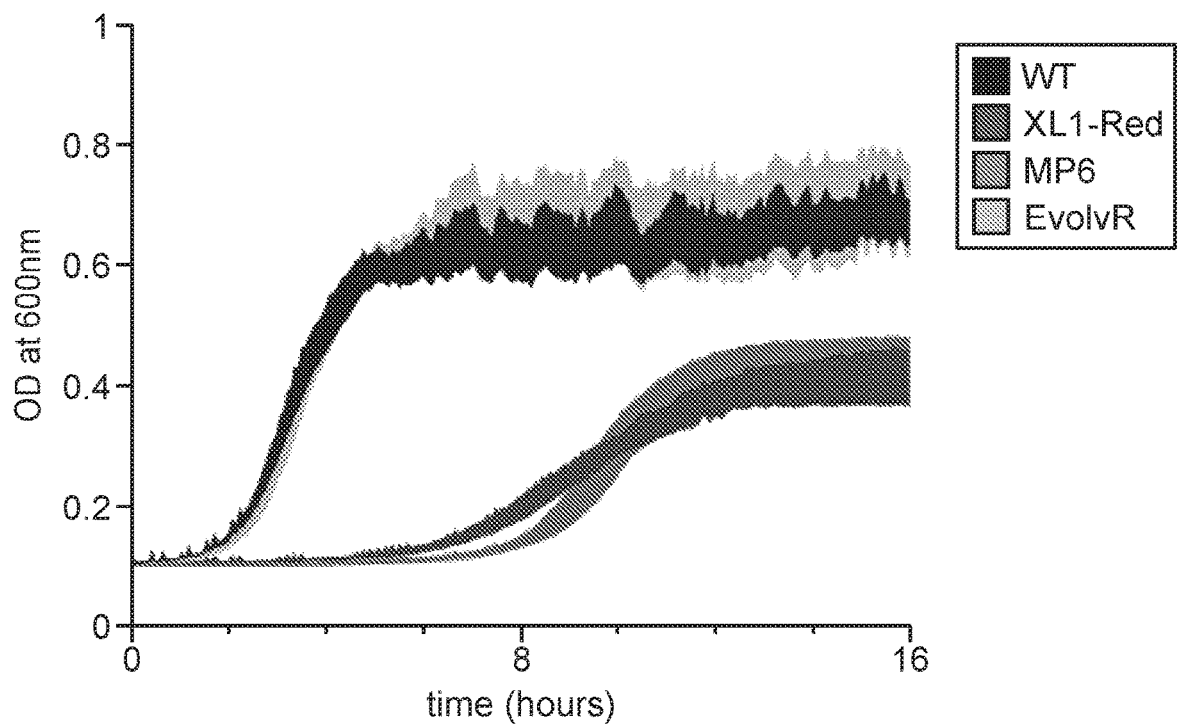

FIGS. 30A-30C| EvolvR enables targeted genome diversification without affecting viability or growth rate. a, The viability of TG1 E. coli expressing EvolvR targeted to the essential rpsE gene was significantly higher than TG1 E. coli transformed with the MP6 plasmid and induced with 25 mM arabinose and 25 mM glucose (as previously described) as well as XL1-Red E. coli. Viability was measured relative to TG1 E. coli transformed with an empty control plasmid. b, TG1 E. coli transformed with an empty control plasmid and TG1 E. coli transformed with pEvolvR targeting the rpsE gene showed similar growth curves while XL1-Red E. coli and TG1 E. coli transformed with MP6 plasmid and induced with 25 mM arabinose and 25 mM glucose grew much slower and saturated at lower final optical densities. c, The spectinomycin resistant CFU per mL saturated culture normalized by optical density of TG1 targeting EvolvR to the rpsE gene was significantly higher than XL1-Red E. coli and TG1 E. coli transformed with MP6 plasmid and induced with 25 mM arabinose and 25 mM glucose. Asterisks (*) denote p<0.05 in two-tailed t-test.

FIG. 31| Locations of gRNA targets and novel mutations relative to the rpsE gene. enCas9-PolI3M-TBD was targeted to five dispersed loci in the endogenous rpsE gene using gRNA's that nick after the $119^{th}$, $187^{th}$, $320^{th}$, $403^{rd}$, or $492^{nd}$ base pair of the 504 base pair rpsE coding sequence. The locations of the previously identified rpsE mutations that provide spectinomycin resistance are colored orange and the region where new spectinomycin resistance mutations were identified is highlighted in red.

Figure 32A:
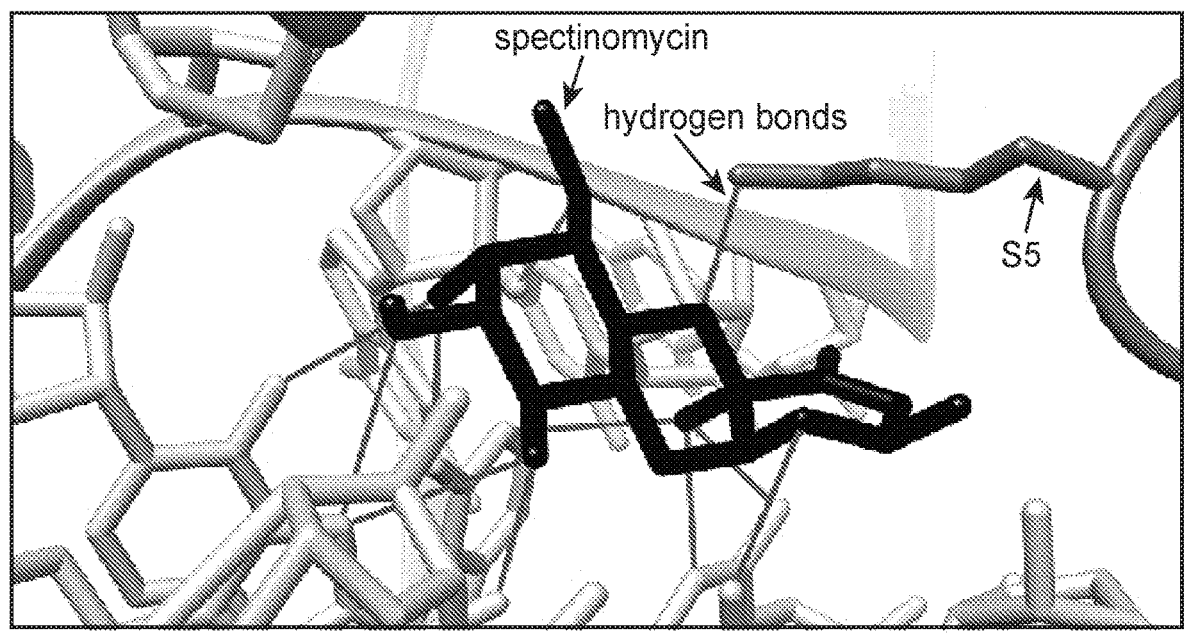
FIGS. 32A-32B illustrate deletions in ribosomal protein S5 and the effect of the deletions on spectinomycin resistance.
Figure 32B:
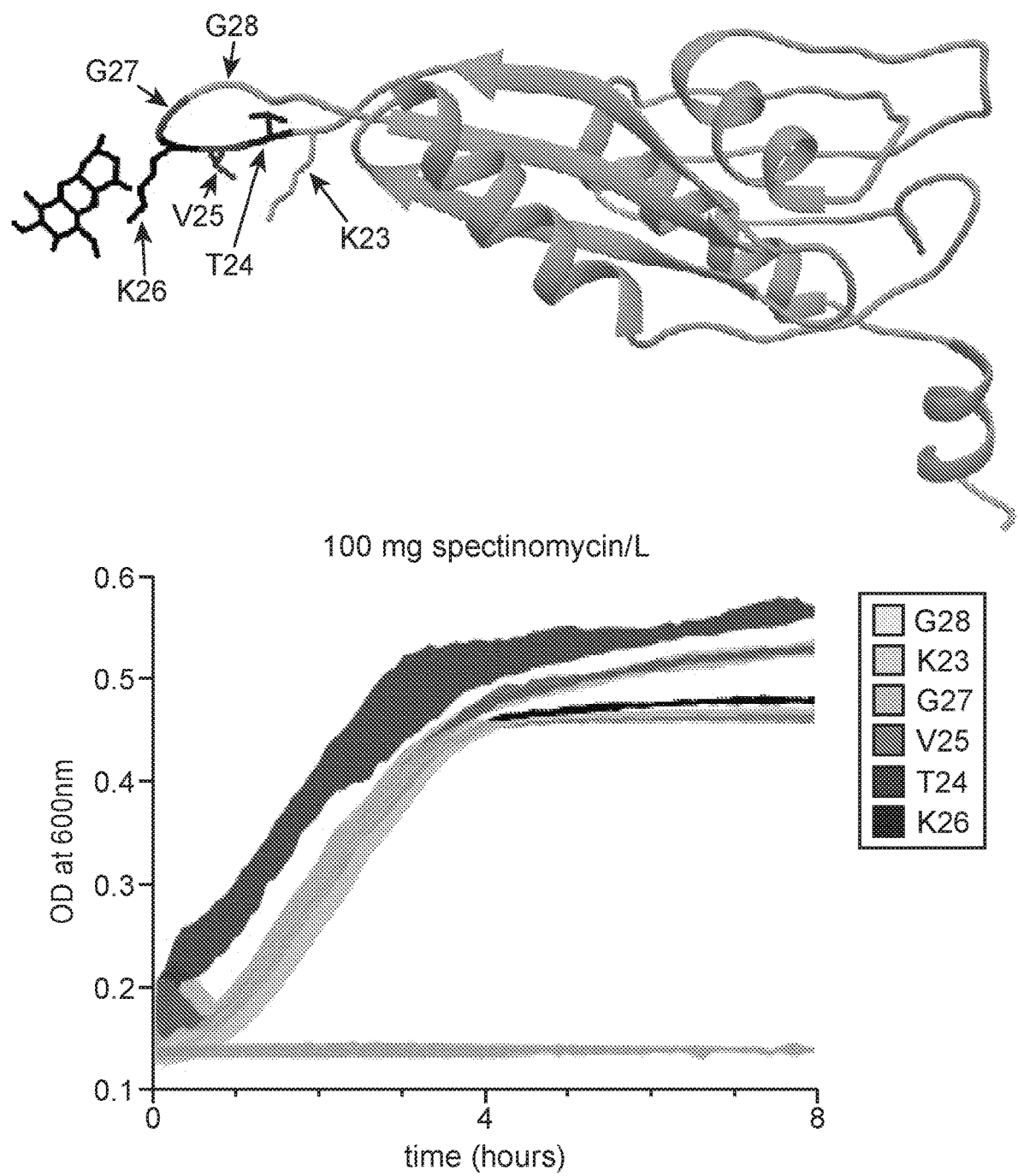
Figure 38:
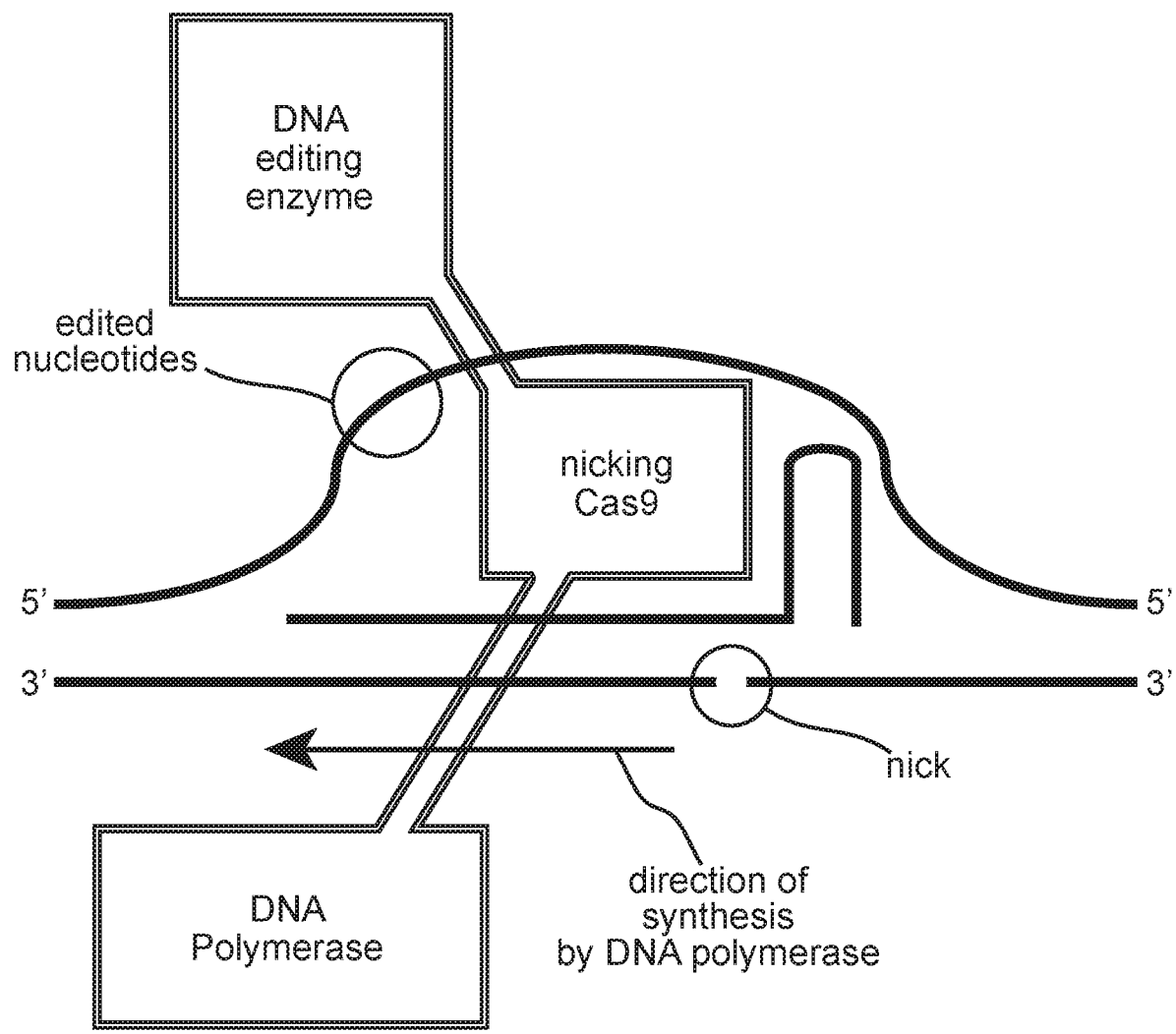
FIG. 38 is a schematic depiction of base editing.

FIGS. 32A-32B| Deletions in ribosomal protein S5 confer spectinomycin resistance. a, The mutations that were discovered confer spectinomycin resistance would be expected to move Lys26, which is predicted to hydrogen bond with spectinomycin, relative to the spectinomycin binding pocket. It was hypothesized that mutations that move Lys26 relative to the spectinomycin binding pocket removes that hydrogen bond and destabilizes spectinomycin's interaction with the ribosome, thereby conferring spectinomycin resistance. b, Therefore, the study tested whether deleting any single amino acid between residue 16 and 35 confers spectinomycin resistance. It was found that deleting residue 23, 24, 25, 26, 27, or 28 all provide spectinomycin resistance, while deleting any of the residues between 16 to 22 or 29 to 35 do not. This supports the hypothesis that one mechanism of resistance to spectinomycin is disruption of the interaction between Lys26 and spectinomycin.

Methods

Plasmid Construction: All plasmids were constructed using a modular Golden Gate strategy[43]. pEvolvR consisted of EvolvR and gRNA expression cassettes, a pBR322 origin of replication, and a kanamycin resistance cassette. pTarget consisted of a p15a origin of replication carrying both a functional trimethoprim resistance cassette for selection and a disabled spectinomycin resistance gene (aadA) harboring a Leu106Ter non-sense mutation. pTarget2 is identical to pTarget with the exception that the aadA gene now carried both Glu98Ter and Leu106Ter mutations. The full plasmid sequences are provided in FIG. 36.

High-throughput sequencing of pTarget sample preparation: A pTarget and pEvolvR plasmid were cotransformed into 50 µL of chemically competent TG1 E. coli prepared by a TSS/KCM method. Cells were allowed to recover in the TSS/LB solution for 1 hour, before 4 µL of the transformation mix was inoculated into 2 mL of LB containing 25 µg/mL kanamycin and 15 µg/mL trimethoprim. The cultures were grown for 24 hours at 37° C. while shaking at 750 rpm. 1.5 mLs of each culture was miniprepped using a Zippy Plasmid Prep kit (Zymo Research).

The oligos pTarget-F and pTarget-R were used to amplify the target region in a 20 cycle PCR reaction using 100 ng of miniprepped DNA as the template. A second PCR reaction added Illumina sequencing adapters and indices to the previous PCR product over 10 thermocycles. A Qubit fluorimeter was used to quantify the DNA prior to pooling samples. The sample pool was submitted to the UC Berkeley Vincent J. Coates Genomics Sequencing Laboratory for quality control and sequencing. Quality control consisted of fragment analysis (Advanced Analytical) and concentration measurement of the sequenceable fraction by quantitative PCR (Kapa Biosystems). The pooled sample was mixed with Illumina PhiX sequencing control library at 10% molarity, diluted to 14 pM, denatured, and run on an Illumina MiSeq using a 150 bp paired-end read MiSeq Reagent Kit v2. Resulting basecall files where converted into demultiplexed fastq format using Illumina's version 2.17 bcl2fastq.

High-throughput sequencing data analysis: Perfectly complementary paired reads were filtered and the 5 randomized nucleotides, amplification primer sequences, and first and last three nucleotides were trimmed using a custom python script. Bwa and samtools were used to generate alignment files using the wild type aadA gene sequence as a reference. VarScan2 was used for variant calling with the parameters: min-coverage 1; min-reads2 1; variants 1; min-var-freq 0.0005; p-value 0.99[44]. The limit of detection was determined by sequencing a culture transformed with an empty vector as a control. The highest frequency variant was 0.04% so all substitutions with a frequency under 0.05% were discarded.

Fluctuation analysis assay: 50 µL of chemically competent TG1 E. coli were contransformed with pEvolvR and pTarget or pTarget2. After 1 hour of recovery at 37° C., 4 µL was inoculated into a 1.996 mL LB containing 25 µg/mL Kanamycin and 15 µg/mL Trimethoprim. After shaking at 37° C. for 16 hours, 1 mL and 1 µL of culture were plated on separate LB agar plates containing 50 µg/mL spectinomycin. Additionally, for viable CFU counting, 300 µL of 1:50,000,000 diluted culture was plated on LB agar plates. After 24 hours of incubation at 37° C., spectinomycin resistant CFU and viable CFU were counted. Ten replicates were used for each condition.

Calculation of mutation rate and statistics: The Ma-Sandri-Sarkar Maximum Likelihood Estimator was used to determine mutation rates as it is the most accurate and valid for all mutation rates[24]. Falcor was used to calculate the mutation rates by inputing the viable and resistant CFU counts for the ten replicates[45]. A simple two-tailed students t-test was carried out to determine p values as previously described[46].

Fluorescence-activated cell sorting of EvolvR libraries: Sony Cell Sorter SH800: pEvolvR expressing either an on-or off-target gRNA was contransformed with pTarget-GFP* and shaken at 37° C. for 24 hours. For each sample, the GFP positive fraction of a million events was sorted with a Cell Sorter SH800 (Sony) using a 488 nm laser and a 525/50 nm emission filter.

Continuous evolution of E. coli resistant to both spectinomycin and streptomycin: pEvolvR expressing enCas9-PolI3M-TBD and either the off-target gRNA (targeting dbpA), rpsL gRNA, rpsE gRNA, or both rpsL and rpsE gRNAs was transformed into TG1 E. coli as previously described. After recovering for one hour, 4 µL of transformation mix was inoculated into 2 mL of LB supplemented with 25 µg/mL kanamycin and cultures were propagated over 16 hours at 37° C. 2 µL of culture was inoculated into 198 µL of LB supplemented with 50 µg/mL of streptomycin. A Tecan M1000 Pro spectrophotometer was used to measure each well's optical density over 12 hours of growth at 37° C. Each well was then diluted 1000-fold in LB supplemented with 50 µg/mL of streptomycin and 25 µg/mL of spectinomycin and the optical density of 200 µL of culture was again measured with a Tecan M1000 Pro spectrophotometer over 24 hours of growth at 37° C. Three biological replicates of each gRNA was characterized.

High-throughput sequencing of spectinomycin resistant E. coli: A pEvolvR plasmid expressing enCas9-PolI3M-TBD with rpsE-gRNA-A, -B, -C, -D, or -E were transformed into chemically competent TG1 E. coli and recovered for 1 hour before innoculating 4 µl of the transformation mix into 1.996 mL of LB supplemented with 25 µg/mL kanamycin. The cultures were grown for 16 hours at 37° C. while shaking. 1 mL and 1 µL of each culture were plated on separate LB agar plates containing 10, 100, or 1000 µg/mL spectinomycin. Resistant CFUs were counted in the same manner as the fluctuation assays. The colonies of each plate were then scraped into separate cultures containing 2 mL of LB supplemented with 50 µg/mL spectinomycin and grown for 16 hours at 37° C. Genomic DNA was purified using the Wizard Genomic DNA Purification Kit (Promega). 100 ng of purified genome was then processed and sequenced in the same manner as already described for the sequencing analysis of pTarget, with the one exception that oligos rpsE-F and rpsE-R were used in the first round of PCR.

Oligonucleotide recombination: Re-introduction of rpsE mutations was performed using RE1000 E. coli (EcNR1 ilvG+dam@λTerm dualTetO-pTet< > {kil, λ cI} ΔampR pConst::araE pConst::araC lacIQ1 recJ_off xonA_off dnaG.Q576A cymR< >SS7) developed for recombineering. Electro-competent cells were prepared fresh from overnight cultures of bacteria. The saturated culture was back-diluted 1:70 into 5 mL LB with 100 ng/µl anhydrous tetracycline and shaken at 37° C. until the OD reached 0.5. Cultures were then transferred to an ice-water bath and swirled for approximately 30 seconds before being chilled on ice for 10 minutes. Chilled cultures were centrifuged at 8000 RPM for 1 minute. The supernatant was aspirated and the pellet was resuspended in 1 mL ice-chilled 10% glycerol. The aspiration and resuspension was repeated twice. The final pellet was resuspended in 70 µL chilled 10% glycerol for each transformation. 1 µg of oligonucleotide was electroporated into the cells. The cells were recovered for 1 hr at 37° C. in 1 mL LB and streaked out on LB agar plates containing 50 µg/mL spectinomycin. Successful recombination was verified by Sanger sequencing a PCR-amplification of the genomic rpsE gene.

Spectinomycin resistance characterization: Single colonies of sequence-verified rpsE mutants were grown overnight in LB media and then back-diluted 1:200 into LB containing 0, 100, or 1000 µg/mL spectinomycin. A Tecan M1000 Pro spectrophotometer was used to measure each well's optical density over 8 hours of growth at 37° C. Three biological replicates of each mutant at each spectinomycin concentration were characterized.

Example 3

The EvolvR system was adapted for use in eukaryotic cells. EvolvR provides for diversification of all nucleotides at user-defined positions without generating double stranded breaks or relying on HDR.

Figure 39A:
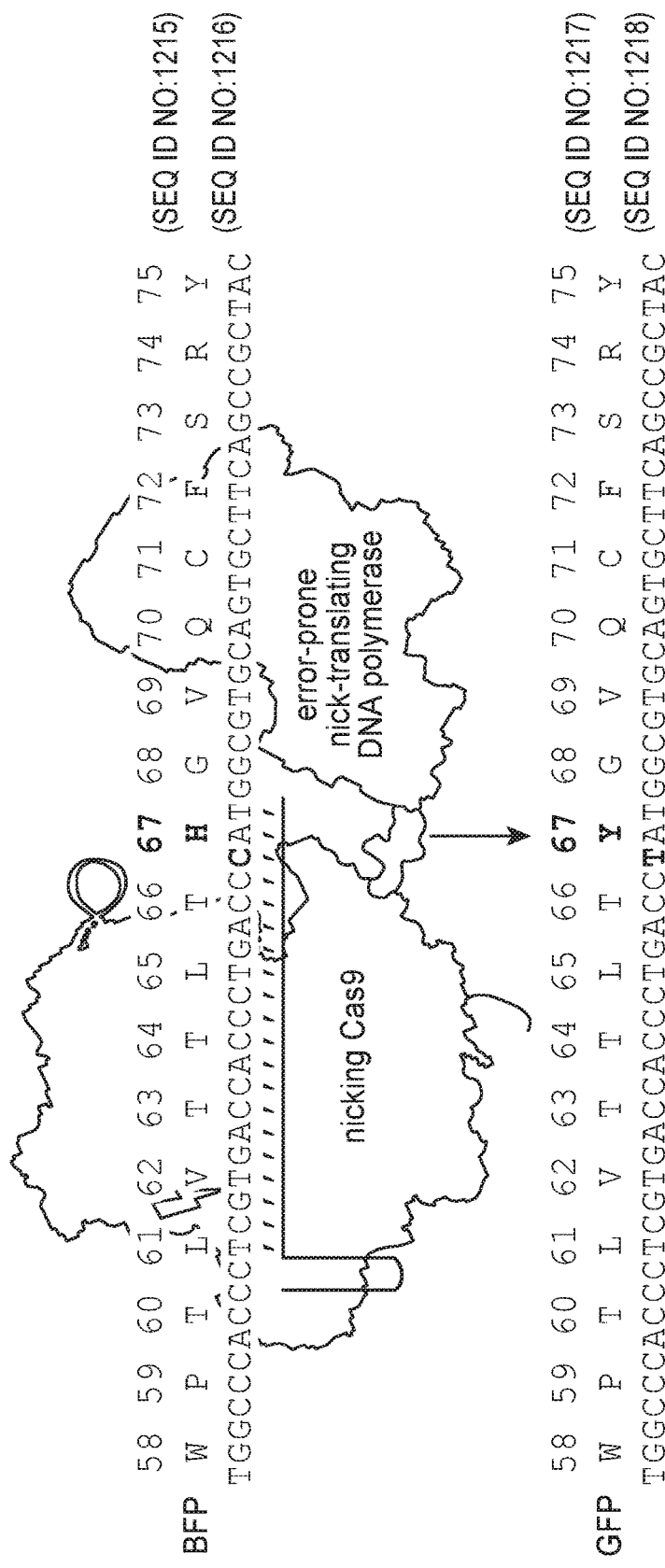

A HEK293T cell line with a genomically-integrated, constitutively-expressed blue fluorescent protein (BFP) gene (HEK293T-BFP) was used. As depicted in FIG. 39A, a BFP gene (SEQ ID NO:1215) can become a green fluorescent protein (GFP) gene (SEQ ID NO:1217) by undergoing a particular single-nucleotide substitution (SEQ ID NO:1218) causing an H67Y missense mutation. The frequency of GFP positive cells in an EvolvR-expressing population was used as a relative proxy for the cell's targeted mutation rate.

Figure 39B:
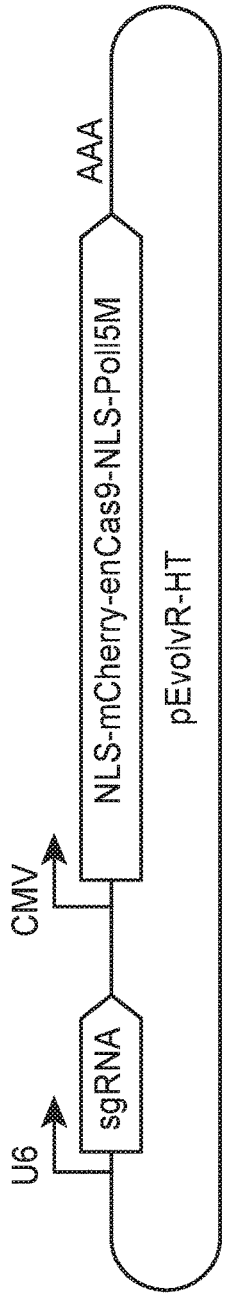

An EvolvR expression plasmid, designated pEvolvR-HT, was constructed. The pEvolvR-HT expression plasmid can be transiently transfected into human cells. As depicted in FIG. 39B, the pEvolvR-HT expression plasmid consists of a gRNA expression cassette driven by the human U6 promoter as well as a CMV promoter-driven enCas9-PolI5M gene tagged with two SV40 nuclear localization sequences (NLSs) and an mCherry fluorescent reporter. Two days after transiently transfecting pEvolvR-HT into HEK293T-BFP cells, transfectants were enriched by sorting mCherry positive cells using FACS. As depicted in FIG. 39C, the sorted population was allowed to expand for five days; the frequency of GFP-expressing cells in the expanded population was analyzed using flow cytometry. As shown in FIG. 39D, while a population not expressing EvolvR and a population expressing EvolvR with an off-target gRNA targeting the aavsl locus did not produce any GFP-expressing cells, a population expressing EvolvR with a gRNA that nicks 15 base-pairs away from the H67Y mutation showed 0.05% GFP-expressing cells. Estimating that the population expressed EvolvR for six generations, the observed mutation rate is approximately $2.5 \times 10^{-4}$ mutations per nucleotide per generation. This mutation rate is comparable to the mutation rate observed in E. coli.

Example 4

The base-pair editor (BPE) system was adapted for use in eukaryotic cells. BPEs provide for editing both nucleotides of user-defined base-pairs by directing the synthesis of a DNA polymerase across deaminated templates without relying on double-stranded breaks, HDR, genome replication, or redirection of endogenous mismatch repair pathways.

A HEK293T-BFP cell line with a genomically-integrated, constitutively-expressed BFP gene was used. As depicted in FIG. 39A, a BFP gene can become a green fluorescent protein (GFP) gene by undergoing a particular single-nucleotide substitution causing an H67Y missense mutation. The frequency of GFP-positive cells in a BPE-expressing population was used as a relative proxy for the BPE's editing efficiency.

A BPE expression plasmid was constructed. The BPE expression plasmid was transiently transfected into human cells. The plasmid consists of a CMV promoter-driven fusion cassette, where the cassette encodes the fusion protein: NLS, rAPOBEC1, enCas9, NLS, E. coli PolI. Three days after transiently transfecting this plasmid with a gRNA expression plasmid and a mCherry transfection control plasmid into HEK293T-BFP cells, the frequency of GFP-expressing cells was analyzed using flow cytometry.

As depicted in FIGS. 40C-40D, the population of cells transfected with the BPE plasmid showed 22% and 22.31% GFP-positive fractions when co-transfected with an on-target gRNA (FIG. 40C), and 0.37% and 0.41% GFP-positive fractions when co-transfected with an off-target gRNA (FIG. 40D). As shown in FIGS. 40A-40B, a similar plasmid lacking the polymerase showed 6.51% and 5.83% GFP-positive fractions with an on-target gRNA (FIG. 40A), and 0.40% and 0.41% GFP-positive fraction with an off-target gRNA (FIG. 40B). These results show that fusing a DNA polymerase to Cas9/deaminase fusions increases editing efficiencies.

REFERENCES

1. Camps, M., Naukkarinen, J., Johnson, B. P. & Loeb, L. A. Targeted gene evolution in *Escherichia coli* using a highly error-prone DNA polymerase I. *Proc. Natl. Acad. Sci. U.S.A* 100, 9727-32 (2003).
2. Crook, N. et al. In vivo continuous evolution of genes and pathways in yeast. *Nat. Commun.* 7, 13051 (2016).
3. Esvelt, K. M., Carlson, J. C. & Liu, D. R. A system for the continuous directed evolution of biomolecules. *Nature* 472, 499-503 (2011).
4. Ma, Y. et al. Targeted AID-mediated mutagenesis (TAM) enables efficient genomic diversification in mammalian cells. *Nat. Methods* 13, 1-9 (2016).
5. Hess, G. T. et al. Directed evolution using dCas9-targeted somatic hypermutation in mammalian cells. *Nat. Methods* 13, 1036-1042 (2016).
6. BRENNER, S., STRETTON, A. O. W. & KAPLAN, S. Genetic Code: The 'Nonsense' Triplets for Chain Termination and their Suppression. *Nature* 206, 994-998 (1965).
7. Maheshri, N., Koerber, J. T., Kaspar, B. K. & Schaffer, D. V. Directed evolution of adeno-associated virus yields enhanced gene delivery vectors. *Nat. Biotechnol.* 24, 198-204 (2006).
8. Bryson, D. I. et al. Continuous directed evolution of aminoacyl-tRNA synthetases. *Nat. Chem. Biol.* 13, 1253-1260 (2017).
9. Hubbard, B. P. et al. Continuous directed evolution of DNA-binding proteins to improve TALEN specificity. *Nat. Methods* 12:939 (2015).
10. Costantino, N. & Court, D. L. Enhanced levels of lambda Red-mediated recombinants in mismatch repair mutants. *Proc. Natl. Acad. Sci. U.S.A* 100, 15748-53 (2003).
11. Wang, H. H. et al. Programming cells by multiplex genome engineering and accelerated evolution. *Nature* 460, 894-8 (2009).
12. Barbieri, E. M., Muir, P., Akhuetie-Oni, B. O., Yellman, C. M. & Isaacs, F. J. Precise Editing at DNA Replication Forks Enables Multiplex Genome Engineering in Eukaryotes. *Cell* 171, 1453-1467.e13 (2017).
13. DiCarlo, J. E. et al. Yeast Oligo-Mediated Genome Engineering (YOGE). *ACS Synth. Biol.* 2, 741-749 (2013).
14. Ronda, C., Pedersen, L. E., Sommer, M. O. A. & Nielsen, A. T. CRMAGE: CRISPR Optimized MAGE Recombineering. *Sci. Rep.* 6, 19452 (2016).
15. Findlay, G. M., Boyle, E. A., Hause, R. J., Klein, J. C. & Shendure, J. Saturation editing of genomic regions by multiplex homology-directed repair. *Nature* 513, 120-123 (2014).
16. Mao, Z., Bozzella, M., Seluanov, A. & Gorbunova, V. DNA repair by nonhomologous end joining and homologous recombination during cell cycle in human cells. *Cell Cycle* 7, 2902-2906 (2008).
17. Aguirre, A. J. et al. Genomic Copy Number Dictates a Gene-Independent Cell Response to CRISPR/Cas9 Targeting. *Cancer Discov.* 6, 914-29 (2016).
18. Choi, P. S. & Meyerson, M. Targeted genomic rearrangements using CRISPR/Cas technology. *Nat. Commun.* 5, 4728 (2014).
19. Frock, R. L. et al. Genome-wide detection of DNA double-stranded breaks induced by engineered nucleases. *Nat. Biotechnol.* 33, 179-186 (2014).
20. Mao, Z., Bozzella, M., Seluanov, A. & Gorbunova, V. Comparison of nonhomologous end joining and homologous recombination in human cells. *DNA Repair (Amst).* 7, 1765-71 (2008).
21. Camps, M., Naukkarinen, J., Johnson, B. P. & Loeb, L. A. Targeted gene evolution in *Escherichia coli* using a highly error-prone DNA polymerase I. *Proc. Natl. Acad. Sci. U.S.A* 100, 9727-32 (2003).
22. Bambara, R. A. & Choi, T. On the Processive Mechanism of *Escherichia coli* DNA Polymerase I Quantitative Assessment of Processivity. *J. Biol. Chem.* 253, 413-423 (1973).
23. de Boer, J. G. & Ripley, L. S. An in vitro assay for frameshift mutations: hotspots for deletions of 1 bp by Klenow-fragment polymerase share a consensus DNA sequence. *Genetics* 118, (1988).
24. Sarkar, S., Ma, W. T. & Sandri, G. v. H. On fluctuation analysis: a new, simple and efficient method for computing the expected number of mutants. Genetica 85, 173-179 (1992).
25. Drake, J. W. A constant rate of spontaneous mutation in DNA-based microbes. *Proc. Natl. Acad. Sci. U.S.A* 88, 7160-4 (1991).
26. Jagessar, K. L. & Jain, C. Functional and molecular analysis of *Escherichia coli* strains lacking multiple DEAD-box helicases. *RNA* 16, 1386-92 (2010).
27. Fijalkowska, I. J. & Schaaper, R. M. Mutants in the Exo I motif of *Escherichia coli* dnaQ: defective proofreading and inviability due to error catastrophe. *Proc. Natl. Acad. Sci. U.S.A* 93, 2856-61 (1996).
28. Wang, H. H. et al. Programming cells by multiplex genome engineering and accelerated evolution. *Nature* 460, 894-8 (2009).
29. Kleinstiver, B. P. et al. High-fidelity CRISPR-Cas9 nucleases with no detectable genome-wide off-target effects. *Nature* 529, 490-495 (2016).
30. Slaymaker, I. M. et al. Rationally engineered Cas9 nucleases with improved specificity. *Science (80-.).* 351, 84-88 (2015).
31. Minnick, D. T. et al. Side chains that influence fidelity at the polymerase active site of *Escherichia coli* DNA polymerase I (Klenow fragment). *J. Biol. Chem.* 274, 3067-75 (1999).
32. Loh, E., Salk, J. J. & Loeb, L. A. Optimization of DNA polymerase mutation rates during bacterial evolution. *Proc. Natl. Acad. Sci. U.S.A* 107, 1154-9 (2010).
33. Truniger, V., Lázaro, J. M., de Vega, M., Blanco, L. & Salas, M. phi 29 DNA polymerase residue Leu384, highly conserved in motif B of eukaryotic type DNA replicases, is involved in nucleotide insertion fidelity. *J. Biol. Chem.* 278, 33482-91 (2003).
34. Wang, Y. et al. A novel strategy to engineer DNA polymerases for enhanced processivity and improved performance in vitro. *Nucleic Acids Res.* 32, 1197-1207 (2004).
35. Whitaker, W. R., Lee, H., Arkin, A. P. & Dueber, J. E. Avoidance of Truncated Proteins from Unintended Ribosome Binding Sites within Heterologous Protein Coding Sequences. *ACS Synth. Biol.* 4, 249-257 (2015).
36. Salis, H. M. The Ribosome Binding Site Calculator. in *Methods in enzymology* 498, 19-42 (2011).
37. Funatsu, G., Schiltz, E. & Wittmann, H. G. Ribosomal proteins. XXVII. Localization of the amino acid exchanges in protein S5 from two *Escherichia coli* mutants resistant to spectinomycin. *Mol. Gen. Genet.* 114, 106-11 (1972).
38. Zheng, X., Xing, X.-H. & Zhang, C. Targeted mutagenesis: A sniper-like diversity generator in microbial engineering. (2017). doi: 10.1016/j.synbio.2017.07.001
39. Timms, A. R., Steingrimsdottir, H., Lehmann, A. R. & Bridges, B. A. Mutant sequences in the rpsL gene of *Escherichia coli* B/r: Mechanistic implications for spontaneous and ultraviolet light mutagenesis. MGG *Mol. Gen. Genet.* 232, 89-96 (1992).
40. Brocklehurst, P. & Peter. Antibiotics for gonorrhoea in pregnancy. in *Cochrane Database of Systematic Reviews* (ed. Kellie, F. J.) (John Wiley & Sons, Ltd, 2002). doi: 10.1002/14651858.CD000098
41. Lee, R. E. et al. Spectinamides: a new class of semisynthetic antituberculosis agents that overcome native drug efflux. *Nat. Med.* 20, 152-158 (2014).
42. Liu, B. & Pop, M. ARDB-Antibiotic resistance genes database. *Nucleic Acids Res.* 37, 443-447 (2009).
43. Lee, M. E., DeLoache, W. C., Cervantes, B. & Dueber, J. E. A Highly-characterized Yeast Toolkit for Modular, Multi-part Assembly. *ACS Synth. Biol.* (2015). doi: 10.1021/sb500366v
44. Koboldt, D. C. et al. *VarScan* 2: somatic mutation and copy number alteration discovery in cancer by exome sequencing. *Genome Res.* 22, 568-76 (2012).
45. Hall, B. M., Ma, C.-X., Liang, P. & Singh, K. K. Fluctuation analysis CalculatOR: a web tool for the determination of mutation rate using Luria-Delbruck fluctuation analysis. *Bioinformatics* 25, 1564-5 (2009).
46. Rosche, W. A. & Foster, P. L. Determining Mutation Rates in Bacterial Populations. Methods 20, 4-17 (2000).
47. Hess, G. T. et al. Directed evolution using dCas9-targeted somatic hypermutation in mammalian cells. *Nat. Methods* 13, 1036-1042 (2016).
48. de Vega, M., Lazaro, J. M., Salas, M. & Blanco, L. Primer-terminus stabilization at the 3'-5' exonuclease active site of phi29 DNA polymerase. Involvement of two amino acid residues highly conserved in proofreading DNA polymerases. *EMBO J.* 15, 1182-92 (1996).
49. Ducani, C., Bernardinelli, G. & Högberg, B. Rolling circle replication requires single-stranded DNA binding protein to avoid termination and production of double-stranded DNA. *Nucleic Acids Res.* 42, 10596-10604 (2014).
50. Povilaitis, T., Alzbutas, G., Sukackaite, R., Siurkus, J. & Skirgaila, R. In vitro evolution of phi29 DNA polymerase using isothermal compartmentalized self replication technique. *Protein Eng. Des. Sel.* 29, 617-628 (2016).
51. Greener, A., Callahan, M. & Jerpseth, B. An efficient random mutagenesis technique using an *E. coli* mutator strain. *Mol. Biotechnol.* 7, 189-195 (1997).
52. Badran, A. H. & Liu, D. R. Development of potent in vivo mutagenesis plasmids with broad mutational spectra. *Nat. Commun.* 6, 8425 (2015).

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (1248 sequences)

SEQ ID NO: 1 - protein, 15 aa, synthetic construct
  REGION 1..15: note = Synthetic Sequence
IGLDIGTNSVGWAVI

SEQ ID NO: 2 - protein, 8 aa, synthetic construct
  REGION 1..8: note = Synthetic Sequence
IVIEMARE

SEQ ID NO: 3 - protein, 27 aa, synthetic construct
  REGION 1..27: note = Synthetic Sequence
DVDHIVPQSFLKDDSIDNKVLTRSDKN

SEQ ID NO: 4 - protein, 8 aa, synthetic construct
  REGION 1..8: note = Synthetic Sequence
HHAHDAYL

SEQ ID NO: 5 - protein, 1368 aa, Streptococcus pyogenes [sequence omitted]

SEQ ID NO: 6 - protein, 1367 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 7 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 8 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 10 - protein, 1368 aa, Streptococcus pyogenes; identical to SEQ ID NO: 8

SEQ ID NO: 11 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 12 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 13 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 14 - protein, 131 aa, Helicobacter hepaticus
MRILGFDIGITSIGWAYVESNELKDCGVRIFTKAENPKNGDSLAAPRREARGARRRLARRKARLNAIKRLLCKEFELNLNDYLANDGELPKAYQTSKDTKSPYELYTAFHWIIFAFCSIASSLSNRQMLPI

SEQ ID NO: 15 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 16 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 17 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 18 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 19 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 20 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 21 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 22 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 23 - protein, 1122 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 24 - protein, 1128 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 25 - protein, 1123 aa, Francisella tularensis
MNVKILPIAIDLDVKNTGVFSAFYQKGTSLEKLDNKNGKVYELSKDSYTLLMNNRTARRHKRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILGTLLTDDFDIWNFNFEKFDFDKNEEKLQNQEDKDHTQAHLHHFVFVVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNTGNQQQALSENSKDVKSLTADEKKLLKLIENIAKASQKIGESLGLNDKQIKKFNSIYSFAQIQQIAFAKRKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 26 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 27 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 28 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 29 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 30 - protein, 1370 aa, Streptococcus agalactiae; identical to SEQ ID NO: 11

SEQ ID NO: 31 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 32 - protein, 997 aa, Maritimibacter alkaliphilus
MKVLVDAGLMPSDPAAAKALETLDPYELRATGLDVMLPLTHLGRAVFHLNQRRGFKSNRKTDRGDNESGKIKDATKRLTWAMQEAGARTYGEFLHMRRARASDPRQVPSVRTRLSVASRGGPDSKEEAGYDFYPERAHLEDEFHALWSAQAAFHPDLTCELRDVVFEKIFYQRPLKEPKVGLCLFTAEERLPKAHPLTGRRVLYETVNQLRVTADGRTTRPLTLEERDMIVYALDNKKPVKSLSSMHLKLVALGKLVKLKDGERFTLESGVRDAIACDPIRATMGHPDGFGPAWSRLDWQAQWALIEKLRQVQSDDDFASLVAWLGATHNLSEDHAKRVANLHLPEGYGRLGLTATEAILCNLKAEVCTYSQAVERWGKHHSNQRTGECLEALPYYGEVLDRHVIPGTYNEDDDDVTRYGRITNPTVHIGLNQLRRLVNRIIATYGKPDQIVVELARELKQSEAQKSEALKKIRDTTADAIRRGRQLEEIGQKNTGANRLLLRLWEDLGPAVGPRCCPYTGKPISVTMLFDGACDVDHILPYSRTLDDSFANRTICLREANRQKGDRTPWEAWGGSDQWDAIEANLKDLPENKRKRFAPDAMERFEGERDFLDRALVDTQYLARISRAYLDTLFTEGGHVWVVPGRMTEMLRRHWGLNALLSDKDRGAGKVKNRTDHRHHAIDAAVIAATDHSLVNRISKAAGQGESAGQSAELIARDTPEPWEGFRNDISAQIARIVVSHRADHGRIDVEGRKHGKDSTAGRLHNDTAYGIVDDHTVVSRTPLLSLKPGDIEVTTKGKNIRDTQLQKALSVATTGKDGKGFEEALRNFAEKEGPYQGIRRVRLIETLQSSARVEVGSDEDGQPLKAYKGDSNHCYDLWKLPDGKVVPHVVSTYEAHAGTDKRPHPAAKRILRVFKKDMVAIEQDDQTAIFYVQKLDRANGLFLAPHLEANADARHRNPNDAFKFLQMGAGSVVRNKLRRVYVDEIGRIKDPGPPKH

SEQ ID NO: 33 - protein, 1027 aa, Blastopirellula marina
MFSESGDQPSLVDCGVRIFPEGVERDQQGGEKSKSQSRRVARGIRRQVRRRAQRLRHLKHALITTGLFPADVVDQQEVLASNPYELRSRALSEKLEPYEIGRILLHLAKRRGFLSNRTTDRSGGNELKGILAEMTQLQGEIAAHGCQTLGQYLHQLGDDGETFAQRLRGRHTLRAMYEDEFEKIWERQASYYPALLTEELRGGEEGKQSYPLVPTARRKSESLLKRFGLHGLLFFQRKMYWPKSVIGRCDLEPKEKRCPKADRLAQRFRILQEVNNLRLISPADRKEYTFAEFVGAGADKKLVDYLCEAKERTFPQIRKKFKLPETISFNYERGERSKLQGHETDAHFNGKKGLGKRRWSEIAEDVKDHIIQIVLEEDREDVALRKLTQDCSLTVEEAHKAMALHLPAGYSQYSRVAISRLLPHLELGKLLMGNDASDSAMHAAGYLRPDEREVRQYDLLPEPPDIPNPLVRQALYEVRKVINAIIREYGALGTIRVELAREAKKSAEQRTQIRIANAKRERENAAIAKTLQEMSPAIRPTRRNIQRYLLWKDQGGVCIYTGKVISQAQLFDSGEVDVDHILPRWRSLDDSMANKVIAHRSANNEKGDRTPWEWLGHDKPRFDELLLRAQRLPYGKRQRFIQKEVELTNFVERQLRDTTYVSRLVVQYLKGLGVPITTVKGPMTAELRHHWGLNALLNEDGSQKKNRSDHRHHAIDAIVIGLTDAKRLHALANARGKDLQPPWSEFRSDVATALGRMAVSHRVRRRIQGALHEETIYGPTQKAAQPTSTDQRPWAKDWIEDSQIVVRRKSVSDLTNTKHLAKIRDVTIRKILEDHLRRQKVDPTKPGVIPKDAFAGSNAPQMPSGVPIKKVRLVERGETWRKIGSGEASKFIKPGSNHHISYFAISRKGRESWKAHVTIMLDAACIAKESINNGKIVNRSIGDQGRFLMSLSIGEMFEITNNGGEILLCVVRKIDQSGRIYYKIHDDARESMDLKKDNLYMSPSKMQQFDARKVTVTPLGKIRNAND

SEQ ID NO: 34 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLSEIYFQAKKLKQKASSELEKLESSKKLDEVIANSQLS

SEQ ID NO: 35 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQSQEDKDHTQAYFHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 36 - protein, 1066 aa, Rhodopseudomonas palustris
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 37 - protein, 1149 aa, Lactobacillus salivarius
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 38 - protein, 1064 aa, Rhodopseudomonas palustris
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 39 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 40 - protein, 641 aa, Nitrobacter hamburgensis
MHKRNSRSYRLGLDLGSNSLGWFVTHLEKRGDRYEPVALDPGGVRIFPDGRDPQSGMSNAVDRRMARGARKRRDRFVDPYALRKAALTNALPAHRVGRAIFHLNQRRGFQSNRKTDRKQSEDGAIKQAASKLKARMHEEAAPTLGAFFADMHLRKSYDDQQTAIRAELVRLGKDHLTGNARKKVWAKVRKRLFGDEVLRPKDTSDGARARATTTGTKASYDFYPTRAMLLDEFNAIWAAQREHHLAMTDEAKAEIEHIIFYHRPLKPAIVGKCTLDPATRPFKEDPEGYRAPWSHPLAQRFRILSEARNLEIRETGKTSRRLTKDQSDLVVAALLANREVKFDKLRTLLKLPAEARFNLESDRRSTATRPPHGCRTRRASIRRGAGFLRNGRSRSSPDWKKPKTKTNCSHGSKWNAHLTAQRPRASPIRRCRTAIAGSACAQSKRSCRSCRTSSMRMALRAPAITSWPSVPATTIPVDTFQQGGNAFGRILSVVTIELFAITDRVDPVQEQDARCFALRIAECRSDGLQHFAEVSLGLPPRNAAQDQRHSAGLCQSSCVGRFVPGTPCRRTPRSTSLHGKEPSAHAFGSTARSRPQLPASPRPCMSFRDGTSSSPARMPETLDRCAISRSNRSSVCRAERL

SEQ ID NO: 41 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 42 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 43 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 44 - protein, 1371 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 45 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 46 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 47 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 48 - protein, 1629 aa, Francisella tularensis
  source 1..1629: note = subspecies Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 49 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 50 - protein, 1125 aa, Francisella tularensis
MNVKILPIAIDLDVKNTGVFSAFYQKGTSLEKLDNKNGKVYELSKDSYTLLMNNRTARRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKIQKFSYTDKQGNLKELSYYHHDKYNIQEFLKRHATINDEILDTLLTDDFDIWNFNFEKFDFDKNEEKLQNQEDKDHTQAHLHHFVFAVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYSFAQIQQIAFAERKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 51 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 52 - protein, 1354 aa, Flavobacterium psychrophilum
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 53 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 54 - protein, 1340 aa, Dorea longicatena
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 55 - protein, 984 aa, Campylobacter jejuni
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 56 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 57 - protein, 1107 aa, Eubacterium ventriosum
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 58 - protein, 1136 aa, Streptococcus gordonii
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 59 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 60 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 61 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 62 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 63 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 64 - protein, 1391 aa, Kordia algicida
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 65 - protein, 1116 aa, Clostridium spiroforme
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 66 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 67 - protein, 1129 aa, Streptococcus infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 68 - protein, 1065 aa, Clostridium perfringens
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 69 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 70 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 71 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 72 - protein, 166 aa, unidentified
  source 1..166: note = uncultured Termite
MNKVQEIEYKKIREKLADREYRIGLDLGVGSIGYVVVSLKECNDLSYLPEDIILSGSRIFKSSIGAVERREFRLQRNSHRHHRERMRFLWQLLAEKQLALQSSKDLEKKENSADCETSQKRFPINILKEDPYILRYKALEEKLSLFQLGYVLYHIANHSNTAYENT

SEQ ID NO: 73 - protein, 1032 aa, unidentified
  source 1..1032: note = uncultured Termite
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 74 - protein, 1032 aa, unidentified
  source 1..1032: note = uncultured Termite
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 75 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 76 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 77 - protein, 1341 aa, Ruminococcus lactaris
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 78 - protein, 1003 aa, Gluconacetobacter diazotrophicus
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 79 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 80 - protein, 1504 aa, Bacteroides dorei
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 81 - protein, 1426 aa, Capnocytophaga sputigena
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 82 - protein, 1443 aa, Parabacteroides johnsonii
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 83 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 84 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 85 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 86 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 87 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 88 - protein, 1509 aa, Bacteroides coprophilus
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 89 - protein, 1219 aa, Bacteroides cellulosilyticus
MKEEVRGKNRSQTWAILAKFFVWSEKESVWNEKEARTEERVKEYKLVGLKRDTKGNELKLENYRWRVQALSEQLNPEIVAIVLQEINGQISASSGYLGAISDRSKQLYFNRQTVGQYLMSELEKDPNVSLRNRVFYRQDYLDEFDRIWEKQAEFHEELTVELKKEIRDIIIFYQRRLKSQKGLISFCEFEKREVVVEEDGRKKNKTVGCRVIPRSHPLFQEFKIWQTLNDIEVFAWDKQSKRKKADKSSILFDNSEDALLVEGKRFLYQEEKELLAKELFVKESMKKAEVLKLLFENYQELDLNFKQIDGNHTGFALFSAYSKMIEKYGYEPVDFKRSADEIIEKLETIFTNLGWNTELLSIDLSKEDKELERQSYFRLWHLLYSFEGDNTPTGNGKLLEKIMQLCDVEKEYAVELANVSFQEDYGSLSAKAIKKILPYLKEGNQYDVACDYAGYRHSRSSLTKDEIENKILKDKLEILPKNSLRNPVVEKILNQMVNLINTLIDTYGKPDEIRVELARELKKNAKEREELTKSIARNTREHDEIRQLLRTEFGMMNVSRNDIIRYKLYEELKDNGYKTLYSNEYIPREKIFSKEIDIEHVIPQARLFDDSLSNKTLEYRAINIEKGNKTAYDFVKEKYGNDGLEKFLNRCETLFKDKRTKLRKLKMEEKDIPEGFIDRDLRNTQYISKKAFAMLNEISRRVVATTGSITDKLREDWQLVDLMKELNLPKYEKLGMVEMFEDKDGRKIKKITDWTKRNDHRHHAVDALTVAFTKDVFIQFYNNKNAAWMPASKEHANITGIKARYFENGKALAPMPLAQFRAEAKRHLENLLVSIKAKNKVITSNVNRTKNKNGENRKLQQTPRGQLHLETVYGSHRQYATKIEKVNAAFDVTKIATVSKLAYRNALLKRLEAFGNDPKKAFTGKNTLEKNPLYLDENQTEMVPEKVQTVEFETVYTIRKPIDPNLSIDKVVDVKIRSVLEKRLKEYGGDAKKAFVNLDENPIWLNEAKGISIKRVSIRGISNAQSLHEKKDKDGNLILGKEGRKIPVDFVNTGNNHHVAIYKKPVLDKVGQVVLDEEGNPKYELDEVVVSFFDAVTRANLGQPIIDKDYRRSEGWQFLFSMKQNEYFVFPNDKTGFNPKEVDLLNPENYALISPNLFRVQKFAYKNYVFRHHLETTIKDTSSTLKGITWTDFRSSKGLDKIVKVRVDHIGQIVSIGEY

SEQ ID NO: 90 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 91 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 92 - protein, 686 aa, Coprococcus comes
MKKQDSPKNNMGYTAYNLNVLGYEEFAKRVELLFKDTDAVKRLNDSHMQMAEGFDLNALPGSPALRRGVSQAIKVLDDIVSVAGKAPDRIYLKVTRTASNSRKGKRTAKRSDKIKQALKALDADAAADLGAAKLLRELGMFDEKEINERIYLYFHQAGKCLYTGKPIDITRIASNDYYVDHVVPLAYRKDESLDNKVLVYAEASRYKSETLLVSPAVQRKMLPFWRMLRNAGLMSERKLNALIRTEISEGMLKSIIGRQFTENSWEAKLFTAAIAAKYPGTVVIPVKAGVIGAVRSRIGIPKSLKANQFYHAHDALLAAEVGRYMELAKPAFVHNRVKYEQYMRKIKLVNEENKKAPKSQLDFFAGGFFFDRVDKDTGEVYWNKDEEVERIYRACGWKNLRVTYAAFEDGGAFWKQTIYSPREKSKLIATKSDRPAEIYGGYSSQTFANFFVYEVMKKKVKQLRFGAVPAAIASKSDPDTYNAMLEMYARGLAKTAKEKFVRIVRARVLKNTMIELYGERFRIAGEKQVYPVRQMPLAIDEVYLLKGVETIAAAGNAGASAKIDFEKAAESLVGFWDLLLEKLPVNYPKLTVQLKLGLLKHPKDILAATSESEFPAIVYKIAEAEIQVMEQASGLRNMSDTKILGGNTFGGSLVFTFNKVLNDPKSKACFIDTTPAGLYEVKTKIW

SEQ ID NO: 93 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 94 - protein, 1361 aa, Anaerococcus tetradius
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 95 - protein, 1377 aa, Lactobacillus brevis
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 96 - protein, 1239 aa, Lactobacillus buchneri
MTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 97 - protein, 1381 aa, Lactobacillus fermentum
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 98 - protein, 1306 aa, Sphingobacterium spiritivorum
MKHILGLDLGTNSIGWALIKQNFENKQGEILGMGSRIIPMGAELSKFEQGQAQTKNANRRIARGTRKLNKRYKQRRNKLIYILQGLGMLPDQIKLVNQFSDPNKLDKISILPISKNQQQLTAFDLLELRVKALTEKIELEELGKVIYKYNQLRGYSGGNSEPEKEENNEDESEENEKTNDSFVVFSKVLSLGLPEEITFKGKKLSKRKIAIETEDGIIEAETFLDSLKENDSLELHVNIRRAKSGDTITIKLPSKTSWRKKMENIEKQLADKSKELGREYFISELLFDILKENKWAKIRNNVILRSRYESEFDAVWSEQSKYYPILNHLETDRLQKILEFIFPGQKESQEKLRQTGLKEGLKYVIKNQVVFYQRELKDQSDLISNCRYEPTEKVVAKSHPVFQEYKIWEQINKLVINTKIENGVNRKGEIRYKYIDKPIPVALKEWLYEELQSKKEVSFNPILTKLKKEFKLRENVDFLNGMNAKDKLKGNETKVILQKALGELWNIFGLDDSERQVELWEILYNGKGNEYDLTSERTSNILAFIEKYSPDLENKNDVAIKISKIKFSRNYSNLSLKAIDNILPLVRAGKFFDQNFSEALSHKIVKLLNENVEDPFEKSAQEFLDKNQDVLSDGGIVNAIATILVYDKHTAKEYSGDELIKEFTQISRLKQGELRNPLAEQIINEALVIVRDIWRKYGFKPDEIRVELARELKNNAVERGKMYSANLKSQKHNAEIRNKLIELKQEISIANIEKYKLWVSQENLQEVYLKNYNDPSKSEIEKLKLWESQGHISPYTGQPISLSELFNRERYDVDHIIPQSRYFDDSLSNKVICEKSINNEKGNRTSMEYFEVGSVNYRIFTKDQFIDHANKYFSGKKRKNLLATSIPEDPIQRQIKDTQYISIRIREELNKIVGNENVKTTTGGITDYLRNHWGLTDKFKVLLKERYEAVLPKIAQLEYDNYKKETEKKFTEYKNADVEFNEPILDEEIFIEKFRSEFIRKKNNKLIIKGWSKRIDHRHHAMDALVIACTQPAHIKRLNDLNQVLKEWLDKNKEKFFPGFSGTKTELLDEVLNLEEEKRREIFNQLEKFRAIEMPWKGFPEEAEQKLKEVIVSHKPKDKLLLQYDIQGNKQIKLRGQLHEGTLYGLSNGKEIYRIPINKLAGKQFATEKTIEKIVNPFLKNVIEEHLKSFGKKEEAFSAEGILDLNKKLAERKDEQQNPKPHPPISTIKIYYKDPSKSKKKKTDDEDDISLQKLNRKKSFNDSLYVKTGDNYLFAVMEKEVFNKKLNKDKTERHYDLKLFLTLLIF

SEQ ID NO: 99 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 100 - protein, 653 aa, Oribacterium sinus
MELINSEEFTFKEELEKHTQVAMKQLSEFTYEDLEDSYFSVPVKRMIWQTLLVVREIEKVMGYAPKRIFVEMTRTEEEKGDKGRKESRGNQLLELYKSIKNTDSHNWKEEIAAADKDGKLRSKKLFLYYMQMGRDMYTGEEIDLGRLYDDNLYDIDHIYPRHYVKDDSIMNNLVLVNRRANQDIKKDLYPIPEQIKANPNVHMLWDALHKQKLITDEKYARLTSNTAFSEKQLGDFIARQLVETGQGTKGVADLLEQLFKDTVIVYAKASNVSDFRRDNGFLKSRLVNDFHHAQDAYLNIVVGNVYYTKFTKNPWNFICKDYEKDKEKNRYNLARMFDWNVVRGSETAWIVERKDEKGTISTVRKMMQKNTPLLTRMNFEQHGSIANATLYSAKKAKSENYLPLKTADEKMSDVKKYGGYTSMSIAYYFIVHHKEDKKENVTIEALPLYCKDKVEREENGLEKYCEEVLGYGEVNIIRRKLKIQSLLEFNGYQVHLSGKTGNQLILRNAISLCLSTKWITYIKKLEKAVNIQIVEEVVTPEENIKLYNLLADKHANTVYSKRPNAYGEKLLADREIFVTLEFGKQCEALLQILSLTKIGSTEANLLLIGESEHSGKILISKNLKASDRPAVINQSPCGLYEKKEWIFDKIVEK

SEQ ID NO: 101 - protein, 1436 aa, Capnocytophaga gingivalis
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 102 - protein, 1069 aa, Bacillus cereus
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 103 - protein, 1391 aa, Lactobacillus jensenii
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 104 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 105 - protein, 1362 aa, Lactobacillus paracasei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 106 - protein, 1056 aa, Actinobacillus minor
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 107 - protein, 1081 aa, Neisseria flavescens
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 108 - protein, 1392 aa, Gemella haemolysans
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 109 - protein, 702 aa, Helicobacter pullorum
MRKILKIDERIQFKEVDYTAKNPENKKFVEFKNLKKFCEILGAIVGDRALADSIARDMTLIKDEEELAQKLRGYGKFSQEQITQLSALHFSHHISLSLKALSEILPFMREGMRYDEACQEAKLQAKHNDKKSKFLPPFCESIYADELTNPVVHRAIAEYRKILNALIAKYGSVHKIHIELTRDVGKNFQEREKYKKEIESNYKARVQAMQECEKLGLTLSEGNILKLRLFREQNEICVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAVDAIIIAYINAAMIQRFSQFRQNQESLKARFYAKELAKEEFKTQRAFFEPFSGFREQVLAKVGQIFVSRPPRKRARGALHEETFYSIDDKKLSETYGGKKGVQRALSLGKIRQIGTKIVANGPMVRVDIFKHTQSGRFYAVPIYTMDFALGILPNKAVVSGKDKDRIIKDWLEMDSCYEFCFSLFKDDVIEVQKRDMEKPELAYFVSLDASDGRIKVRHHCNDITKINENQKKLFSEAIEKEVVGRGSIQNLKVFKKYKVSPLGEIKEAKYEPRQPIALKTSPKKHRKQNNAQ

SEQ ID NO: 110 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 111 - protein, 1007 aa, Helicobacter canadensis
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 112 - protein, 1397 aa, unidentified
  source 1..1397: note = Gammaproteobacterium
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 113 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 114 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 115 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYIGPLSKGDASTFAWLKRQSEEPIRPWNLQETVDLDQSATAFIERMTNFDTYLSSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 116 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 117 - protein, 1424 aa, Parabacteroides sp.
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 118 - protein, 1395 aa, Lactobacillus jensenii
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 119 - protein, 1140 aa, Roseburia intestinalis
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 120 - protein, 992 aa, Treponema vincentii
MQKNSGEDENCGFEFLTEEEKELIKPLFFRISKPSFQFADIEKKLKGKNGFWKFNYRKDTNVSGCPVSAGLKNIFGDEASAESWKDKKVGQYDMCDIWHVLFDFDDEEKLLEFAKRKLFLSDEAAKKFCAIRIQQGYANLSLKAIRKITPFLRKGYIYSTAVFLANIPFMIGRDIFLQNEKEIEDSVKNIIGTLRDKNNIIVLANRCIESAFKDKDNDFRFEEWDKALVENSAWDLFGKKKWNEYDEEKRKTIISQVSEKVEDNLKIAVGKNPNDYKYPLLRTDDLIMDYLNQKGFVVKGELYHPSDTDYNFETPVPAEDGKIYLASPRSPSVKNPVVMRALHQLRKLVNYLIKTGKIDSTTKINVELANDVNDKNQRKAIEELAKTNEKNNADARKKIEELCNEAGFKVVPTESDIKKFRLWKEQNETCPYTGKHISFTDLFGPIPKFDFEHTIPRSLSYDDSLENLTLCDSEFNRNIKKQRLPSELPDFEEINKRFLKFYEDKIDNCLRIIELNSKSGGSYEEPAVKDLRIVKKHKAQYELNYYKEKLRRFSSTEITSGFKHSQLNDTRIITKFSLSYLKGVFDHVQPVKGSMTDTFKRQWGLMERNEIKDRSNHTHHTVDALTVACINRGKFNLLSEAIKNSSDGKHLKFPKPWETFDTDVLNAVRYIIPKYFSDESSLRQSKKILRGRDGKPVLKNGKAVFIQGATARGSLHKDTFYGCIKTVPEKGGKSEMIFVQRIPVSTLDEKVAEKIIDKRIRKTFEKNLSTGIQTLQEIQTDGILLPFKKEGRDVFVKRVRIKAHPTSPIILKKHHNVINKNPKDYKQNYYVENEENYLLAIYRGKDAKGKDVSDHKLCNLLNAVKSRQNKTGFYPDFKEKKGINLQLYKVLKIGKIVILQNDIQEDVFALPKEKLWKRMYRIAGLATSRNDIQIKLVHIIRETPWGYMKGEKDLNAGKECLLYGTANFKGLVEGQDFTVSPAGEIIQKARVC

SEQ ID NO: 121 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 122 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 123 - protein, 1234 aa, Prevotella tannerae
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 124 - protein, 1496 aa, Prevotella veroralis
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 125 - protein, 1082 aa, Neisseria cinerea
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 126 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 127 - protein, 1259 aa, Streptobacillus moniliformis
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGD

SEQ ID NO: 128 - protein, 1091 aa, Mobiluncus mulieris
MDSRKYRVGIDVGTNSVGFAAVEEDDSGSPTRFLNTMVVIHDSGVDPEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 129 - protein, 872 aa, Candidatus Parvarchaeum sp.
MLGSSRYLRYNLTSFEGKEPFLIMGYYKEYNKELSSKAQKEFNDQISEFNSYYKLGIDLGDKTGIAIVKGNKIILAKTLIDLHSQKLDKRREARRNRRTRLSRKKRLARLRSWVMRQKVGNQRLPDPYKIMHDNKYWSIYNKSNSANKKNWIDLLIHSNSLSADDFVRGLTIIFRKRGYLAFKYLSRLSDKEFEKYIDNLKPPISKYEYDEDLEELSSRVENGEIEEKKFEGLKNKLDKIDKESKDFQVKQREEVKKELEDLVDLFAKSVDNKIDKARWKRELNNLLDKKVRKIRFDNRFILKCKIKGCNKNTPKKEKVRDFELKMVLNNARSDYQISDEDLNSFRNEVINIFQKKENLKKGELKGVTIEDLRKQLNKTFNKAKIKKGIREQIRSIVFEKISGRSKFCKEHLKEFSEKPAPSDRINYGVNSAREQHDFRVLNFIDKKIFKDKLIDPSKLRYITIESPEPETEKLEKGQISEKSFETLKEKLAKETGGIDIYTGEKLKKDFEIEHIFPRARMGPSIRENEVASNLETNKEKADRTPWEWFGQDEKRWSEFEKRVTSLYSKKKISERKREILLNKSNEYPGLNPTELSRIPSTLSDFVESIRKMFVKYGYEEPQTLVQKGKPIIQVVRGRDTQALRWRWHALDSNIIPEKDRKSSFNHAEDAVIAACMPPYYLRQKIFREEAKIKRKVSNKEKEVTRPDMPTKKIAPNWSEFMKTRNEPVIEVIGKVKPSWKNSIMDQTFYKYLLKPFKDNLIKIPNVKNTYKWIGVNGQTDSLSLPSKVLSISNKKVDSSTVLLVHDKKGGKRNWVPKSIGGLLVYITPKDGPKRIVQVKPATQGLLIYRNEDGRVDAVREFINPVIEMYNNG

SEQ ID NO: 130 - protein, 1229 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDIREIYLAVHHIIKYRGNFLNGTPMRSFKVENIELNTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKGIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRHLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIEREKKVVAPETGEILWSNVAPNETIKQIKKVYNYKFMIVSREITTRRAELFNQTVYPKNYRGKLIPIKEDRPTDLYGGYSGNTDAYLAIVALEDKKKGKYFKVVGIPTRAAAKLEKLKQQDSQQYLQALHEVIAPQFTKSTKKGIKKTEFEIVLDKVHYRQLVQDGPVKMMLGSSTYKYNAKQLVLSEKAL

SEQ ID NO: 131 - protein, 1398 aa, Veillonella parvula
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 132 - protein, 1485 aa, Prevotella bivia
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 133 - protein, 1218 aa, Prevotella buccalis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 134 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 135 - protein, 1487 aa, Prevotella timonensis
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 136 - protein, 1138 aa, Bifidobacterium dentium
MLCRCHRRYRIGIDVGLMSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 137 - protein, 587 aa, Neisseria subflava
MATSRSRIRSQTDAFGVVGSLVAFNQTSRLFVAKKNEGETADKELGALLKGVADNAHALQTGNFRTPAELALNKFEKESGHIRNQRGDYSHTFNRKDLQAELNLLFEKQKEFGNPHVSDGLKEGIETLLMAQRPALSGDAVQKMLGYCTFEPTEPKAAKNTYTAGRFIWLTKLNNLRILEQGSERPLTTTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYIEIDHALPFSRTWDDSFNNKVLVLGSENQNKGNQTPYEYFNGKDNSREWQEFKARVETSRFPRSKKQRILLQKFDEDGIYRIGVKTALSFPKYQIDELGKEIRPCRLKKRPPVR

SEQ ID NO: 138 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 139 - protein, 1354 aa, Prevotella melaninogenica
MADFAKYQPGMVADGRKIPLDWTLYYLRKKALTQAIRKEELAWILLNFNQKRGYYQLRGEEEEENSTKHEEYYELKVVSVEAAEEGKGGNTWYNVTLENGWIYRRQSKIELNDWVGKVRPFIVTTEYEIDGVTIKKDKNGEVKRSFRAPSENDWGLRKKRTESLLEESGKTVGAFIYNHILSEPADKIRGNFIRTIERKFYKKELEAILREQSKHQKELKDIDTLIACIKELYPNNKPHQDSLIKKDMTYLLITDLIFYQRPLKSKKSLIADCPYEYYEYVIKETGENKRQSIKCIAKSNPYYQEFRLWQFIINLRLFDRNNDKEVTSEYLSSMEDYTRLFTYLNDRKDINQETLLKDFFKQKKVKRGMEKEFPIRWNYIEDKEKKYPCNETRHELLTALGKVGIDHSWLDDKELFYRLWHLLYSVESKEEAEGALRKLVDNDDFVNAFLKIKPFKKEYGAYSEKAIKKLLAVMRMGNLWNEVDICEQTRDRIQNIIKGDIDEKIKDRMGRTFSQLSDFQGLPEWLACYVVYGQHSEATDIQRWTKPENLMAYINGFKQHSLRNPIVEQCILETLRTVHDIWKEAGHIDEIHIELGRGMKSTADQRARMSKSIMQNENTNLRIKSLLMELKNAKEFENVRPYSPMQQEILRIYEEGALQELTKEDAQYNEISKISQMAQPSANELLKYRLWLEQKYCSPYTGKPISLSKLFTSAYQIEHIIPQSRYFDDSFTNKVICEAEVNQLKSNMLGYEFIKKHGGEIVRCTMIGDVKLLDAKEYYNFVTEHYTNNRRKKEKLLMEDIPQEFLNRQMNDSRYISKKVMAILSNIVREEDEQEAKSKFVIACSGGITDRLKQDWGLNDVWNSIVYPRFERLNKLTNTENFGRWENKKGKQVFQTSVPLELQKDFSKKRIDHRHHAMDALVIACASNNIINYLNNESAKSQEKREDLRKKLCDKNRIIRKPWETFTQDAHTALENVVVSFKNYIRVINKATNYYEKYDKNGKKEIAEQKGQDMWAIRKPMHKETVFGQVNLRRKITIKLKDALEKIPAICDKELRDYINILVAKQFNKKQILAHFKSINYRLNMKSVDKVDVWQFSNEKEPMVATRKSVDTSFDTKRIATITDTGIQKILLNYLKAKNNDPNIAFTPEGIAEMNKHITEYNNGKQHQPILKVRVSEPKGAKYQVGETGNKRSKFVEAQKGTNLYFAIYEDKEGNRSYNTIPLNEVIERLKQGLSPVPDANEKSIPLKFHLSPNDLVYVPKTDEENEIKMGQIYKFVDSSGTTANFVPHRVSNLIYNVDKKIAENFCNHEIIQNEYGIGSPQSKNQKSITGEMIKAVCWKLEVDRLGNIHKIIK

SEQ ID NO: 140 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 141 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 142 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 143 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 144 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 145 - protein, 765 aa, Butyrivibrio fibrisolvens
MGITIGLDLGVASVGWAVVNDDYEILESCSNIFPSADASKNSERRGFRQGRRLTRRRKNRIHDFQKLWEDKGFVIPSQGTEDVLAIKIKGLSEKLSVDEVYWVLLNSLKHRGISYLDDADSGDNSSDYAKSISRNEEELKEKLPCEIQWERLQKYGAYRGNISIVEDGEPITLRNVFTTSAYKKEVEQFIDTQAKYNAQYSGDFKADYLEIFNRKREYYEGPGNELSRTDYGKYTTEINADGEYITVDNIFDKLVGKCSVNPDERRAAGASYTAQEFNVLNDLNNLTISSESSFIEDGKLTEDAKRKIIETIKNAKTVNVKKIICDVIGDKKCQISGARIDKNEKEIFHSFEAYNKMRRALEEIGFDISSLSRENLDLIGDILTLNTDRESILNAFNRKGIELADEAKDILVKVRKTNGSLFNKWQSFGLSIMNELIPELYAQPKNQMELLTAMGVFKSRGDRFLECKEIPGDLIVDDIYNPVVSKTVRITVRILNALIKKYGYPDRVVIEMPRDKNSDEEQQRLKKEQRDNENEIKDIKARVKTEYGREITEEDFRQHSKLSLKLKLWNEQQGICPYSGKSIKIDDLLDNPNLFEVDHIIPLSISFDDSRNNKVLVYSSENQDKGNRTPLAYLASVNRQWDIHSFMDYVLKTYAGAQKRKKRDNLLNEQDITKVEVLQGFVNRNINDTRYASKVVLNSLQEYFSSKECSTKVKVIRGSFTHQMRVNLKLKKTVMNHMFIMQLMQCLLLFHRWDMTLIMNLQISI

SEQ ID NO: 146 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 147 - protein, 1035 aa, Candidatus Puniceispirillum sp.
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 148 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 149 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 150 - protein, 1178 aa, Scardovia inopinata
MGKRHNSNMAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 151 - protein, 1371 aa, Gordonibacter pamelaeae
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 152 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 153 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 154 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 155 - protein, 1434 aa, unidentified
  source 1..1434: note = Bacteroidetes oral taxon 274 str. F0058
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 156 - protein, 1341 aa, Peptoniphilus sp.
MWGSRLFEEASTAQDRREHRSNRRRLERRKYRLDLLEELFVEEINKIDPEFFIRLRESKFHFEDRSLKNTFILFNDKMEGGYNDKVFFSKYPTIYHLRSALINGNKEDVRAVFLAIHNILKNRGHFLLAGNDINISLSLNDTLTDLFEYLKIHLGIEVEFENKLKDIEKIALDKNLSKSDKQKKIVQLLETDYKKQLADVFKLSLGLTANMENIFGKENEQGLEFINAENKIKKIQFDSSYEENIAEFDQFYGEYFEIIDICKKIYDAISLSQILVDGKGLSESKVLSYEKHKEDLKLLKKVLKNIDKAYDNKGEDRLVYKVLKEDKDKGTNYVNYSKLSNNGTATTKEEFYKFLSKNLDLKKFGKLNKEDIETLDYINSEILLGRFLPLQKEKINGVIPYQLQMKELTQILNNASKYLPFLNKIEDGMTVKDKIISLIKFRIPYYVGPLNEYNRIENGNGFAWIEKKKNEKIFPWNFNDVVDIEKSAEKFINNLTNKCTYIKEETVLPKNSIIYSKFMVLNELNNLQYGNKKLDIELKMKMYTDLFLEKKDNRKVTEKRILEYFRINGINDGKEKLTGLNNEIHADMKSYRDMCEIMGENFNINVAENIINWITVFHGEKKILINKIKNVYGKMFNDEQISKLSKLNYSDWGRLSKKLLTDIKCYIDADGINFPVSILEAMEVSNKNLMELLSNKYEFISCIDDINNKYFGDRDISASELIDELYVSPAVKRGIWQSVRILEEIVSIIGHNPKKIFIEMTRHNEEKVQKSSRRHNLEELYKAIRKDPEYVELIKEFDSTTDTDSFKIKKLYLYFMQLGKCAYSKEKIDFDKLFTDSYDIDHIYPRSKTKDDSIHNNLVLVKAKYNREKTDVYPIDINIQKNMNSFWNFLYTKKFITEEKYKRLIRTSDLTDEELAKFISRQLVETSQSTKATAEVLKQIYGDSDICYVKAENVSDFRYGSSRQKDKNDIQKLFVKCREVNHFHHAKDAYLNIVVGNVYDVKFTKNPVNFIKKNKMGNKSNYSLNHMFCFDVERNGYKAWDSSETIKTVGRMMKSNDVRITKHVHPTRGELYDATIYKAKIAKTGSYMPLKSSKNTPLSDVTKYGGYTKIKIAYYSVYKYKFSDKNLIKTEIRLIPIPIYLSKNDDDIKEYVKNYLNDRVNSKLIDFTKIYDKLYVNSLIKINGYLYYLGGKTNDRVWIDNAVSIVLDDKIEYLIKRISNDIKYGYEINVSDDELMDIYESLAEKANKKIFYNRLSDFEKIFSNMDVKKKFVKLEKNDKCRVLLQLLNVLTDSQTTYKLEMVGLKHSRSNIGMKISNLEEFKVINSSITGLYSNEIDILNI

SEQ ID NO: 157 - protein, 1391 aa, Lactobacillus gasseri
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 158 - protein, 1426 aa, Sphingobacterium spiritivorum
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 159 - protein, 1361 aa, Lactobacillus casei; identical to SEQ ID NO: 75

SEQ ID NO: 160 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 161 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 162 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 163 - protein, 1398 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 164 - protein, 795 aa, Prevotella disiens
MEKQRILGLDPGTNSLGWAVLDFDNSKQEYNLVRKGEVIFEEGVGKSKRGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYVLGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKKQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTIPRSLGGDSTKMNMTLCENKFNRENKQKKLPSELANHSEILERIDDWKKKIYILQKKYDSIRTHNGMDKENKDKKIVSMQVRISGSSICVYSQNTLLWLQYGYN

SEQ ID NO: 165 - protein, 1428 aa, unidentified
  source 1..1428: note = Burkholderiales bacterium
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRKGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVHSICNAIENERKTYGPYFSEDYKFVKTALKEGKTEKELSKKFAAVIKVLKMVSEVVPFIGKELRLSDEAQSKFDNPYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGASDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 166 - protein, 1025 aa, unidentified
  source 1..1025: note = Gammaproteobacterium
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 167 - protein, 1364 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 168 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 169 - protein, 1089 aa, Corynebacterium matruchotii
MNSANVNYRVGIDVGSYSLGMAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQAGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 170 - protein, 1134 aa, Streptococcus mitis
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 171 - protein, 1373 aa, Streptococcus bovis
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 172 - protein, 1099 aa, Corynebacterium accolens
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 173 - protein, 1054 aa, Actinobacillus pleuropneumoniae
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 174 - protein, 1369 aa, Lactobacillus iners
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 175 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 176 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 177 - protein, 994 aa, Streptococcus downei
MENQRGKRQRITHQEPYSIGLDIGTASVGSAVINNDLTVPQKRFKVRDINGNVIKTIKKNMSSVLIFDEANPAKGARTKRTSRRRYTRRNFRLLELKKLFEKEIEKIDPNFFHRIKEDSFFNWNDKEFDKHPLFGNLKEEKKFHNNYPTVFHLRNEIGKNSSKKFDLRLVYLALAHIIKYRGHFLDETFDPDASVSVEKRLNDFIVEYNELFDKDLRSEAKFSEILMSDSSNSVKIESTLSLYPSEKNTIFQVFLKLIVGNQGDFNKFFKDELESSSHSGKLVFSSDEVEDEKEELISIIGEDYLDIINLCQSLYSTVALAKIISTDTGESNTPLSASMVKRYNEHKGDLANLKGIVKHFIPEKYEEVFGEHSKTGYTAYIRNPNKMPEKKFYDYLYHEGEKGKISGILSDSRIYELPAVQKFILKIEQKSFLKKQRTKENGLIPYQLHLKELKIIIENQSEYYPFLHEIEEKLEKLLTFRIPYFVGPLAQTKYINPRFNWLVRKSEDHIKPWNFSEIVDEEKSATKFIEKLISNDQFLFGEKVLPKRSIIYQQFLIFNELTKVSYQIKDGPSRNFDSETKEEIFNSLFKKNKLGCVTVVDLKNYIKNDQCLSEKEDIQIEGIKKKFNSSYSTYADLSEISGLKELLDDDTQLDLVEEIIRILTVFEDKKMRTKQLEKLNLPANVDIEKLCKKHYKGWANVSRQLIDGIADRSRGFKKTILDYLKDDDIPNNDAFSTKVQKSLNRNFAQLITDKSLDFARKLDESYKIDVKKDYPSLVEDIPGSPAIRRAILQSLYTVDEIIGVMGRMPKNIVIEMARTNEVSDSPKTRKERIKKLIKETENDADALNFGISKVSEIFDEVKKDENLFKELEVYLYFLQEGKDMYGTETREGHRQPKEINFYDVKNSTGKYHIDHIIPQSLYSGNPLDNIVLTESTNNKIKDKDVPDEATVYEMKNFWLYLMKKGAISKKKFSFLTKIEQGGLSNEDKFGFINR

SEQ ID NO: 178 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 179 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 180 - protein, 874 aa, Listeria seeligeri
LANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 181 - protein, 1082 aa, Neisseria lactamica
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 182 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 183 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 184 - protein, 1150 aa, Enterococcus faecalis
MYSIGLDLGVSSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGINDVAKLLGVKKERLSGWRLDKKGKPEIHTLKGYRNWRKIFAESGIDLATLPTETIDCLAKVLTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKNNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 185 - protein, 1345 aa, Streptococcus anginosus
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 186 - protein, 849 aa, Listeria ivanovii
  VARIANT 780: note = X can be any naturally occurring amino acid
LIDKNGTPQHITMIDKMRGKCTYFPEEVRIAKMSYTAELFGLLNDFNNIYFADPETGEKIGFTEADKKYFIDTFIHDQKGVKNITLKQIMKHKNIINETDIFGYRINTKNGTPIFTEFKGLKALKKALKEVDLPDEFYQNTEMMDEIANILSSEKSFTRREEQLKELFLAAFNDELEEAVKELINDITFKEFHSLSKKAIMVILPELWSTNQNQMQLFVQHKMDKSRLENLQNGTKIQFDDEAILSTIAKRAHRETIKIVDAVRAKYGELDYVIVEMAREKNSDEQKKVYNRAQKKQGDFEKEMCKLLGVSELKELRLNGKQHLALKFWKEQDGKCIYSGKPIALSDIVNNFNGLLEIDHIIPISISYDDSQQNKVLCLRSENQRKGQLSPYQYLIRGMGERSFDAFKAEVLSRHFGKKKQNYLLEMEDIANNDELRKHFINRNLVDTRYAMRTFSNTLKTFYTVNGIPTKVMPVNGAMTSALRKRAKLNKDRDAGHAHHAIDALIVAAIGRLPLIKQLAELRVNEEGEFADKITDKGLDDKTAFDDKTLKFLRNLLNYESKVKYSHKVDRKPNRSLSKQTLYSTREKDGEKYIIGKVKNIYTLDKAGYAALKKRIDKNPEDFLMAQHNPKTWEEIIKIMEVYSKADNPFKEFYDEHGFIMKDGKVPVKSLRYHDKKLGIHVPLTHKYENTRHDVVLLKRNSLRVDIYMNKEGVYKYQGVPYNWFNQKGDKYILDMEKYHNEIDGTRASFKNIDNTFEFQFSLYKNDVFSYMKKDKEGEXVSYTKLFRSDSSPRENRLEVENIDMRTSSQQMPTINPLKNLIKYNTDILGNTYPIQKEKFVTVFTLHSK

SEQ ID NO: 187 - protein, 1457 aa, Prevotella buccae
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 188 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 189 - protein, 1123 aa, Mobiluncus curtisii
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 190 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 191 - protein, 586 aa, Pseudoramibacter alactolyticus
MTYYLGLDMGTGSVGWAATDKNYKLIRAKGKDLWGVRLFQTAKTAAERRSHRVARLRRQREKVRIGYLKTIFSDAINKVDPGFFQRLDDSFFYAEDKNINQPYALFADTGYTDVDYYRDYPTIFHLRSTLIHDTSPKDVRLVYLAVLNMFKHRGHFLASNLSENGVDDFGDIYQQWCKSVPKPVQISDPEAKTEKIENILSKAGISNTRRLEALLEVFGIKRRDAFAEVLKLWCGLKGNLSKIWSETDFSDLDNTKPALSFKDSNLDMVLSQLEEILPDEDYSWLMLTKQIYDWSLLSGMMKDASGKSYDYLSDARVASYQKHSEDLKTLKRFYHDNHLSAAYDQMFRVMGKDNYSAYAGSVQSKKEVVRRGASCGIEELYKRIKKDLKPVPDCETKQIILENIERGTFLPKQLTRDNGVIPNQIHVHELKAILKNAENYLPFLKEGSELTNSEKILQLFQFQIPYYVGPLYSDENNYAWVVRKEGGRVFPWNFAEKVDEKASAEGFISELVARCTYLDNEKVLPKASLLYEKFMVLNELNNLRINGERISVDIKQELYQNLFTRGKKVTLKKSEGLFGGQRIFCL

SEQ ID NO: 192 - protein, 1385 aa, Gemella morbillorum
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 193 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 194 - protein, 1422 aa, Sutterella wadsworthensis
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 195 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 196 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 197 - protein, 738 aa, Treponema phagedenis
MLQELFAKEIAKIDEGFFRRLDESAFYLEDKSLKQKYSLFNDDNFTDKDYYKKFPTIHHLIKALINDETHVDIRLLYLACHTIIKNRGHFLFEGKEFNTESRFDDAINELFSYLRQDMEIDFAFEDKIADIKEILENKKIGMRDKQNALNKKLSIAPKDKQKKEIIKLIVGASFNLKTLFNDEKYSSEKESYSFAKSNYEEKEAVLESLLGDGFGLILRAKAVYDSSVLSEILGNETYLSFAKVKIYDKHKEDLAKLKKVIKTYHADEFKKVFAEANIQGNYCSYVGSCKKNGKKVPIEKRADKDAFYDFLKKILKDEKAKNSDADYAFILNEIELKTFLPKQVSKKNANIPYQLRRMELEKIVNNAEKYFSFLSEKDEYGTVKEKIIQLLTFKRPYYIGIIQDTHKEKFPDRCWVVKKENAKNEKITPWNFYDHIDEDKTAEAFITSRTNKCTYLIGEDVLPRNSLLYMEYTVLNELNNLKVSVDGVNIFDVKLKKKIYEQVFKQRKEVSKKTIADFLKKEGICKKENDVVITGIDEKCTTSLKLYIDIKKIIGKRIEEEPTKNALEDIILWASIYDEGEGRKILEAKIQSVYPDVFTQDELNKILKLKISGWGRFSRKFLESIVASFPGFTDTINIITAMRETNFNLMELLGDAYGFSKGIEKFNSKFNDDKKVFSYDKLVKDLYLSPSVKRMLWRALVIVKEVKSIMGKDPKKYLLKWQEEKKLKREGLPPAMQV

SEQ ID NO: 198 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 199 - protein, 1128 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 200 - protein, 1080 aa, Methylocystis sp.
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 201 - protein, 1087 aa, Phascolarctobacterium succinatutens
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 202 - protein, 1375 aa, Lactobacillus ruminis
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 203 - protein, 1391 aa, Prevotella oralis
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 204 - protein, 1167 aa, Streptococcus sanguinis
MLFGLKTKFKDCFELEEEPDLNFSKENYDDNLEKLLGELGEDFSDVFDKLKILRDTILLSGMLTYTGATHARFSATMVERYEEHRKDLQRFKSFIKQNLSEQDYLDIFGRKTQNGFDVDKETKGYVGYITNKMVLTNPQKQKTIQQNFYDYISGKITGIEGSEYFLNKISDRTFLRKLRTSDNGAIPNQIHAYELEKIIERQGKDYPFLLENKDKLLSILTFKIPYYVGPLAKGNNSRFAWIKRANSSDILDDNDEDTRNGKIRPWNYHKLINMDETRDAFITNLIGNDTILLNEKVLPKRSLIYEEVMLQNELTRVKYKDKYGKAHFFDSEHRQNIINGLFKINSKRVNAERLIKYLSDNHKDLNAIEIVSGVEKGKSFNSTLKTYNDFKTIFSEEFLDSEIYQKELEEIIKVITVFDDKKSIKNYLTKYFGHLEFLDEEKINQLSKLRYTGWGRYSAKLLLDIRDEDTGFNLLQFLRNDEENRNLTNLISDNTLSFDPKIKAIQSKSTVEDDVFDEIKKLAGSPAIKRGILNSIKIVDELVQIIGYPPQNIVIEMARENMTTEEGQKKTKTRKSKLESALKNIENSVLENGKVLHSDEQLQSEKLYLYYLQNGKDIYSLDETGSPAPIYLDQLDQYEVDHIIPYSFLPIDSIDNKVLTHRKNNQRKLDNIPDKETVAHMKPFWEALYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHVHFNRHEENKATLRKHLYSNIMRFFNNPDSKVSKDIWDCNRDLPIIKHVIYNSQINFVKRTMIKKGAFYNQNPVGKFNKQLAANNRYPLKTKALCLDTSIYGGYGPMNSTLSIIIIAERFNEKKGKIETVKEFHDIFIIDYEKFNNNPFQFLNDTSENGFLKKNNINRVLGFYRIPKYSLMQKIDGTRMLFESKLNLHKATQFKLTKTQNELFFHMKRLLTNSNLMDLKSESAIKESQNFILKHKEEFDNISNQLSAFSQKMLGNTTSLKNLIKGYNERKIKEIDIREETIKYFYDNFIKMFSFVKSGAPKDINDFFDNKYTVARMRPKPDKRLLNATLIHQSITGLYETRIDLSKLGED

SEQ ID NO: 205 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 206 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 207 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 208 - protein, 1179 aa, Sphaerochaeta globosa
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 209 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 210 - protein, 1044 aa, Nitrosomonas sp.
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 211 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 212 - protein, 1218 aa, Prevotella denticola
MKASEEKLSKGLSTYMKENNLLTVGAAFAQLEDEGVRIRNNNNYRAIRSQFQHEIETIFMFQQGLSENELYERLVSEKKNIGTIFYKRPLRSQRGNVGKCTLERTKPRCAIGHPLFEKFRAWTLINNIKIRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGEQWKKLYHPSQIAIYRPVSAGKDRSALRLGNPDIGAIKNPTVLRVLNTLRKRVNQLLDDGLISPDETRVVVETARELNDANRKWALDNYNRIRHDENEKIKKILEEFYPKRDGISTDDIDKARYVIDQREMDYFTEEKPYNKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQFAKDKDGKVLLKEGHPLVDPTIKFVIRRELKYKKSTADSGFASWDDLEKAIVDKELFALMKGQFPEETSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 213 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 214 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 215 - protein, 1077 aa, Neisseria bacilliformis
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 216 - protein, 1029 aa, Alicycliphilus denitrificans; identical to SEQ ID NO: 193

SEQ ID NO: 217 - protein, 1122 aa, Streptococcus suis; identical to SEQ ID NO: 87

SEQ ID NO: 218 - protein, 1428 aa, Parasutterella excrementihominis
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 219 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 220 - protein, 1090 aa, Sphingomonas sp.
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 221 - protein, 1000 aa, Kingella kingae
MARAQRRLISRRANRMNKLRRLLKQENVLQANDYDEKGLIIGLPNQAWELRAQGLDRKLEPKEWAAVLINLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQEQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 222 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 223 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 224 - protein, 1126 aa, Lactobacillus farciminis
MADRISLGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 225 - protein, 1380 aa, Eggerthella sp.
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 226 - protein, 1430 aa, Capnocytophaga canimorsus
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 227 - protein, 1348 aa, Finegoldia magna
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 228 - protein, 1352 aa, Megasphaera sp.
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 229 - protein, 650 aa, Haemophilus pittmaniae
MENKNLHYILGLDLGIASVGWAVVEIDKEENPLCLIDVGVRTFERAEVPKTGESLALSRRLARSARRLTQRRVARLKKAKRLLKLENILLSTDERLPHQVWQLRVEGLDRKLKRQEWAAVLLHLIKHRGYLSQRKNESKSENKELGALLSGVASNHELLQQTTYRTPAELAVKKFEVEEGHIRNQQGAYTHTFSRLDLLAEMELLFSRQQHFGNPFASEKLLENLTALLMWQKPALSGEAILKMLGKCTFEDEYKAAKNTYTAERFVWITKLNNLRIQENGLERALNDNERLILIEQPYEKAKLTYAQVRSILNLSDEAIFKGLRYSGEDKKAIETKTTLMEMKAYHQIRKVLEGNNLKAEWTELKENSTLLDEIGTAFSLYKTDEDISTYLAGKLSQPVLNALLENLSFDKFIQLSLKALYKLLPLMQQGLRYDEACHEMYGDHYGKKTYGKKTEENHYFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKNNAS

SEQ ID NO: 230 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 231 - protein, 1052 aa, Haemophilus parainfluenzae
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 232 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 233 - protein, 1473 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 234 - protein, 933 aa, Mycoplasma iowae
SVRDYSDGPGSEKSPTPYGLWRLNKEGKVEKIGENLWDVLVGKCTIYGNDDSIKDEKTKLRGGKNSPIAEVFNFINDLTNIYLFSSSKLKLNSKTKLSILDEFNISLKTSKPIKSFSEKKLVKHIISTTEFKDINFDDVYGYRIDTSKKPLFTKLENTITIAKWLLDNNVYNELNIYDQEDLIKINNIFVILQKSMDINKRAQLVSDEYKIDLPICLELVKKIKGVMQTHSFSYKAMLEYIPVGIKYNDLETGEDTSINASTYFVDKINNLNTKLLFNGRPRKYIPKNIFEDGIISPTSKRAFIQTINVLNKIIKVYSKDYDIDNIAIELPRDKNTAEERKKISSNQKKAGEEIAEVLKFAGLNVEEYTSKLNSKTKLKLKLLKEQNYKDIYDGQEIDVIDVIKNSNKYHEEHIIPYSLCFIDSRRNKVLTKFENNKQKGNKTPFQWLSSIGKYAEFKDRVEKLFVEQKISKAKKELLLFEQDPRTEMLGFIEKNLSDTRYASKLVFDTFRDFFKVNNPNVKIKVINGALTNYARYNLFATYKDGLLERKGIMKQREFYEHHGIDATILAFLGSNHKINQLLKLSHKFKKQDDNKIYDENTGELIEFTKDFLSDEARKKAMELSKQIFEIPCKFSRPIYRKSNVSFSNETLISMKWIDDKYTKGVKINKLSLVNKDLDLNEYFADYETNEMKNLICYQEDKTLYNKLKNIYDKYNNFVENSNIKPVKNPFINYMISNFSSDDSKIQNFKHIIFYDHKGNKKFVKSLKVCGDEKNLSNIVLRKDQKDIMNSKKIKKSGILESLNPISARIYKDNKGKYITIPINSLVLNWTKKGLEIDNEKLCNILKSKNIFNNQFIEINAGQSIINNENKLFYFVGGGDFKVNKLEIKSQFCDNEIFFPRKQMNISIATIIDNYKLCEVDELGKIYNIRKIVL

SEQ ID NO: 235 - protein, 1358 aa, Acidaminococcus intestini; identical to SEQ ID NO: 99

SEQ ID NO: 236 - protein, 983 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 237 - protein, 1338 aa, Streptococcus macacae
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 238 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 239 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 240 - protein, 1459 aa, Flavobacterium columnare
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 241 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 242 - protein, 1425 aa, Prevotella micans
MIQKIFGLDLGTNSIGSSVRNLELGENLTEQLEFFSSDIFGSSVSKNSNGREYSLAGNRSAHRRSRGLNEARRRKLWATLDLLIEHGLCPMSPDSLMQWRTYDKQKGLYRQYPIEDKDFNAWIMLDFNGDGKPDYSSPYQLRRELVVRQFDFDQPIERYKLGRALYHIAQHRGFKSSKGETIADQEKNEKKPIAEEGADIANEMKASETKLSKGLVAYMQENHLKTVGEAFAKLEDERVRIRNNESYRAIRSQYQDEIKEIFTYQKKLSVESELYERLTSEKKGVGTIFYKRPLRSQRGNVGKCTLERNKPRCPIGRPEFEEFRAWTLINNIKIRETAGEPYKQLPIKLRQELLKDCFLSKVKADFKFEDIRKYIEKRLGLSFSNDDKTINYKDSVSIAACPVTVRMKKLLGENWANCRIDGEKRRQAHGKNNNNEHIVSYTEEDIWHVCYNAEDPEEVSNFARKALHWDENKIKELVRLWTSIPQGYAMLSLKAIRNINRMLLLGLKYSDAVLLAKLPDIVPVSDEDILAITKEFLQLEDKLNQEKQINNIVNSLIANYKSKLEENRFADHNYQYQLGEGDDEDINTQIKSHIGAKLWVQIGADEQTKIFQAVRSKYQDFFKSYKRKFVESPKLGELLVAFLTEKFPNVKSKQWERLYHPSQIAIYRPIPVDNDRSKLRLGNPNIGAIKNPTVMRVLNTLRRRVNQLLDDGVISPDETRVVVETARELNDANTKWALDRYNRIRRDENEKIRKILKELNPTTNSISEQDIDKARYIFEQCETDFYTDGKVPYYNKDIKKYKLWLEQGGQCLYTGQTINLTNLFNPNAFDMEHTIPKSISFDNSDQNLTLCESYYNRFIKKNNIPTDMPNYDKDVTINGKEYTAIKPRLQRWKERVDRLSRNVDFWKGQARRAQDKDRKDECIREKHLWDMELAYWKGKLERFTMTDVTDGFKNSQLVDTRVITRHAVLYLKSIFNHVEVQRGETTAEFRKILGLQSIDEKKDRSLHSHHAIDATMLTVIPSAAKRDRMLELFYKIEETKKALKNYNDNNKTGLNLELKGLEEKLDKEKKDCRVGRRVNDLDRFINENIIVSHHTKDQALTPAHRRLRKRGKIVGGKEHPRWQTGDSLRGEIHKASYYGAITQFAKDANGKVLMKDGQAQIDPTIYYVIRRELKYKRSTQDSGFTNWEDLEKVIVDTDLFGLMKGQFPEGTSFKDACEQGFYMIKKGKNGEGDVKTHRIRHVRCKAVKTALRIKEQTYKSSKDYKQFFYAAVGDLYVMCYYTDGKKRDFKIYSLYDISNHRKSGTEDIPKFITDKKGNHLPLDYKLRTGDMVLLYKDNPEELKDLDQVNLKRRLYKVNRFESEGLIILLTHHLSTTTERGCSIGKIENYQNLPTAIRCGIKTIKFLIMGKHRDFVIRNGNIEFKH

SEQ ID NO: 243 - protein, 1473 aa, Mucilaginibacter paludis
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 244 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 245 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 246 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 247 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 248 - protein, 1375 aa, Lactobacillus johnsonii
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 249 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 250 - protein, 1063 aa, Simonsiella muelleri
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 251 - protein, 1509 aa, Psychroflexus torquis
MKRILGLDLGTNSIGWSLIEHDFKNKQGQIEGLGVRIIPMSQEILGKFDAGQSISQTADRTKYRGVRRLYQRDNLRRERLHRVLKILDFLPKHYSESIDFQDKVGQFKPKQEVKLNYRKNEKNKHEFVFMNSFIEMVSEFKNAQPELFYNKGNGEETKIPYDWTLYYLRKKALTQQITKEELAWLILNFNQKRGYYQLRGEDIDEDKNKKYMQLKVNNLIDSGAKVKGKVLYNVIFDNGWKYEKQIVNKDEWEGRTKEFIITTKTLKNGNIKRTYKAVDSEIDWAAIKAKTEQDINKANKTVGEYIYESLLDNPSQKIRGKLVKTIERKFYKEEFEKLLSKQIELQPELFNESLYKACIKELYPRNENHQSNNKKQGFEYLFTEDIIFYQRPLKSQKSNISGCQFEHKIYKQKNKKTGKLELIKEPIKTISRSHPLFQEFRIWQWLQNLKIYNKEKIENGKLEDVTTQLLPNNEAYVTLFDFLNTKKELEQKQFIEYFVKKKLIDKKEKEHFRWNFVEDKKYPFSETRAQFLSRLAKVKGIKNTEDFLNKNTQVGSKENSPFIKRIEQLWHIIYSVSDLKEYEKALEKFAEKHNLEKDSFLKNFKKFPPFVSDYASYSKKAISKLLPIMRMGKYWSESAVPTQVKERSLSIMERVKVLPLKEGYSDKDLADLLSRVSDDDIPKQLIKSFISFKDKNPLKGLNTYQANYLVYGRHSETGDIQHWKTPEDIDRYLNNFKQHSLRNPIVEQVVMETLRVVRDIWEHYGNNEKDFFKEIHVELGREMKSPAGKREKLSQRNTENENTNHRIREVLKELMNDASVEGGVRDYSPSQQEILKLYEEGIYQNPNTNYLKVDEDEILKIRKKNNPTQKEIQRYKLWLEQGYISPYTGKIIPLTKLFTHEYQIEHIIPQSRYYDNSLGNKIICESEVNEDKDNKTAYEYLKVEKGSIVFGHKLLNLDEYEAHVNKYFKKNKTKLKNLLSEDIPEGFINRQLNDSRYISKLVKGLLSNIVRENGEQEATSKNLIPVTGVVTSKLKQDWGLNDKWNEIIAPRFKRLNKLTNSNDFGFWDNDINAFRIQVPDSLIKGFSKKRIDHRHHALDALVVACTSRNHTHYLSALNAENKNYSLRDKLVIKNENGDYTKTFQIPWQGFTIEAKNNLEKTVVSFKKNLRVINKTNNKFWSYKDENGNLNLGKDGKPKKKLRKQTKGYNWAIRKPLHKETVSGIYNINAPKNKIATSVRTLLTEIKNEKHLAKITDLRIRETILPNHLKHYLNNKGEANFSEAFSQGGIEDLNKKITTLNEGKKHQPIYRVKIFEVGSKFSISEDENSAKSKKYVEAAKGTNLFFAIYLDEENKKRNYETIPLNEVITHQKQVAGFPKSERLSVQPDSQKGTFLFTLSPNDLVYVPNNEELENRDLFNLGNLNVEQISRIYKFTDSSDKTCNFIPFQVSKLIFNLKKKEQKKLDVDFIIQNEFGLGSPQSKNQKSIDDVMIKEKCIKLKIDRLGNISKA

SEQ ID NO: 252 - protein, 1112 aa, Staphylococcus simulans
MLVGLKFKQSILFENMENAEDIKESATGSDAISLSDDYYENLSEFLTDEQLNFIESANTFFMGIMLDRILKGATSISAAKVRDYKIFKSQLKLIKDIVYQNKYDKYHEFFVTSKEDMRAYQENPDAKNFGKLSKFDQYLIHSKDQYAKLMKDLKGLVPKEYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAILGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQAKGKRQKSRSELWDDLVKKNNLKRNKEFEGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEYGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 253 - protein, 1274 aa, Mycoplasma gallisepticum
MNINMNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 254 - protein, 1122 aa, synthetic construct; identical to SEQ ID NO: 23
  REGION 1..1122: note = Synthetic Sequence

SEQ ID NO: 255 - protein, 1236 aa, synthetic construct; identical to SEQ ID NO: 21
  REGION 1..1236: note = Synthetic Sequence

SEQ ID NO: 256 - protein, 1059 aa, synthetic construct; identical to SEQ ID NO: 15
  REGION 1..1059: note = Synthetic Sequence

SEQ ID NO: 257 - protein, 1166 aa, synthetic construct; identical to SEQ ID NO: 39
  REGION 1..1166: note = Synthetic Sequence

SEQ ID NO: 258 - protein, 1149 aa, synthetic construct; identical to SEQ ID NO: 37
  REGION 1..1149: note = Synthetic Sequence

SEQ ID NO: 259 - protein, 1314 aa, synthetic construct; identical to SEQ ID NO: 27
  REGION 1..1314: note = Synthetic Sequence

SEQ ID NO: 260 - protein, 1064 aa, synthetic construct; identical to SEQ ID NO: 38
  REGION 1..1064: note = Synthetic Sequence

SEQ ID NO: 261 - protein, 1401 aa, synthetic construct
  REGION 1..1401: note = Synthetic Sequence
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVD

SEQ ID NO: 262 - protein, 1368 aa, synthetic construct
  REGION 1..1368: note = Synthetic Sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 263 - protein, 1368 aa, synthetic construct
  REGION 1..1368: note = Synthetic Sequence
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 264 - protein, 1368 aa, synthetic construct
  REGION 1..1368: note = Synthetic Sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 265 - protein, 240 aa, Acetobacter aceti
MANIAENLVFGIDLGIGSCGWAVLNQKAKDENIVALGSWCFDVPETDKERIPTNQIRRANRLLRRVIRRRRNRMAEIRRLFASKGMLDTADPDALAKISADPWEMRAKGLDYQLTPQEFAVALGHIAKRRGFKSAAKRVSTNAPSEDSKMLAALEKTKEQSAQYRTIGEMFARDPAYADRRRNRDGCFDRTMSREDLFKETQILFESQRRLGNFSATSETEQAFIDIAFRQKPMQDSERL

SEQ ID NO: 266 - protein, 400 aa, Acetobacter aceti
SFERFRLLCRLVNLRVTDGLEDRPLTPEELRLACEDAGKTRKLSVKKVRSLIGLRDDQRFTTIPPDQEQHDIAARTGDALTGTATFRAILGESFWRQLLPHPEQLDRAAWIISFHELTDTIISKLATIGLPSEVMELIRKALEDGKFSKFKGAASLSDKAARKLIPFLQEGLTYDKACQKAGYNHAASKFTHYDSIDTKAKFNSLMDDVRDSITNPVARKAISEGMKQVWAMRNQWGLPGAICIELARDVGNSAEKRREIESGIKKNTAQRERERQEAKEHLNQSDISSETLLRYRLWKEQGGRCCYTDQPITPSQLIASDNSVQVDHILPWSRFGDDSYLNKALCTAKANQEKKNRTPWEWIHNQKGVEAWNHFTAAVESRKETRGLKKRNFLLKSSKE

SEQ ID NO: 267 - protein, 376 aa, Acetobacter aceti
YAARVMAEAVRLLYPSGNRAEKGGVKRVFTRPGALTAALRHAWGVESLKKINGKRLNDDRHHALDAAVVAAVSEKEIQKLTKSFQICEQKGLARPMRDVPMPWEGFRHQLETAYADIRVARPERRRARGKGHDATIRQLREEKDGPVVYERRAISDLKLTDLERIKDPERNSAIISSLRTWIEKGKPADYPPQSPKGDEIRKIRVMSRNKPAVSVRGGTADRGEMTRVDVFTKMGKKGKPEWFLVPIYRHQVIDRIQWPQPPNQAAANGKSEKNWPTMGLEHEFRFSLYPRSYVQIVKRDGEIIEGYFAGLDRTVAAFSLLSSSDPTSIQRGIGAKTLESIRKYNVNRFGDISMVEQETRTWHGDVCISPDQPDSA

SEQ ID NO: 268 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 269 - protein, 239 aa, Actinobacillus ureae
MEIRIFSENPKLGLENRLPGYPQYNHEFVQPLFVSRMPTRKMTGKGHMETVKSAKRLDEGLSVLKVPLTQLKLSDLERMVNREREDALYQSLKAHLEQFGNDPAKAFAEPFHKKGGTVVKAVRVEQTQKSGVLVRDGNGVADNTSMVRVDVFTKAGKYFLVPIYKWQVAKRILPNKAVTAGVDEIDWLEMDSSYQFIFTMYANDLVKVKLKKRSILGLLRWFRSCNWGYCYQRTRFREI

SEQ ID NO: 270 - protein, 400 aa, Actinobacillus ureae
MKLTPLNYILGLDLGIASVGWAVVEIDEQENPLGLIDVGVRTFDRAEVAKTGESLALARRLARSSRRLVKRRADRIKKAKRLLKAENLLLSADEILPNDVWQLRVKGLDQKLERQEWAAVLLHILKHRGYLSQRKNESKSENKELGALLSGVATNHQLLQTAEYRTPAEITVKKFQAEENGHGHIRNQRGDYSHTFDRKDLLAEMKLLFQRQAELGNPHTSEKLLENLTTLLLWQKPALAGEAILKMLGKCTFEPAEYKAAKNSYSAERFVWLTKLNNLRILENGIERALTDNERFTLLDQPYEKAKLTYAQARTMLALSDEAIFKGVRYQGEDKKAAEKVALIEMKGYQHIRKALEGAGLKAEWNELKNNSELLDDIGTAFSLYFSISNLPTEIAYFTP

SEQ ID NO: 271 - protein, 1113 aa, Actinomyces georgiae
MSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 272 - protein, 1101 aa, Actinomyces naeslundii
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 273 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 274 - protein, 1120 aa, Actinomyces sp.
MNAMKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 275 - protein, 1095 aa, Actinomyces sp.
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 276 - protein, 1144 aa, Actinomyces sp.
MSMIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 277 - protein, 1103 aa, Actinomyces sp.
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 278 - protein, 1114 aa, Actinomyces turicensis
MQFHFYMVYVTMKGMNDKDASQQLRYRVGIDVGTHSIGFCAVEVDESGMPIQLLNSMVHKHDSGIDPGGNDTATTRLAEAGVARRTRRLIRRRKKRLQELDAFIEECGWPLVDLATITDARSPWRIRAHLATEHIDDEAEQGKLLSIALRHMARHRGWRSPYARISSLHIQADPSEQLKALAQRVSEKTGISLTADQTPAQLISVYLDVFETGKLRGPEGILGGKLMQSDNANELRRIATVQGLDNDLLKKIIGFVFAAESPKGSAAKRVGKDVLPGAHGLRAEKAHPAFQQFRIVSIVQNLRIKEGTGLRALTSEETEIVVDFLNQAGLTEAPTWEEVADNLEIPRSHLKGTATEGFDGIAPSTRPPFDVTSQKILNGKLKKLSAWWKDADYDHRCAMVNALSNVGSDDEGSLADDDVREFLSDFTDEELEALDKVELPGGRAAYSVDSLEKLTNTMLSEGCDLHSARKIAFGVDDSWTPPAEPIGQPVGNPAVDRVLKQVARWISAATNQWGTPESVNIEHVRDALGSEKASREYQRSLQTRRIRNEKLFAEMRERLDIGGKPRRSELTRYLALQRQNCQCLYCGMPITYTDAEMDHIVPRKGAASTNTRENFAAVCRACNHQKSNLPFAVWAEKTERPGVSVKEAYKRVSDMRIEPGMNGRQMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPGIAQTIALRMNMRESQRVLGEQETWKSFTGGSDTARKRWEHWCEEMLRASELFNVFLAEDRIPICQNKRLRLGSSAVHKAIVQPFEASDKRIVSDAMPVELIDRASTPALWTALTRDPDFDPKEGLPANPSRTIRLHDKRLGPNETVEFFPTAAACLAIRGGYCEIGAGIHHARIFRISGKKTTYAMLRVYQCDLVRFQKENLLTVELPANTISVRTAVPKLREALAHGTAEQIGWLVVGDELKIDLSGFTTGQIETFNETYPQATRWEVTGFPTKTQLRLKPLLIASEGLADDVPDDIVKIVKGPGWWPAIDKLLKIGNVVLYRRDTHGKPRVVSHRSLPLSSKLQ

SEQ ID NO: 279 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 280 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 281 - protein, 1552 aa, Anaerophaga sp.
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 282 - protein, 1515 aa, Anaerophaga thermohalophila
MKRILGLDLGTNSIGWALVESDEEQKSGKIQGIGSRIIPMDQNELDNFNKGNTVSQTAERTRLRMVRRLRERHLLRRERLHRVLKEIGFLPEHYLEQIDFTEKPGGFLPGKEPKIAYKPDNFKDKYDFLFQDSYHEMLSDFQDKNPEFIQKRKKVPQDWTIYYLRKKALTAKITKEELAWIILNFNQKRGYYQLRGEDEDVAKNTKKEEFHALKVVKVKEREDSEGASGKWYDIELENGWVYPRQSNIRPDWEGKILELIVTYNLDKDGNIKTDKEGNEKRSFRMPNKDDWTLRKKRTENEIEKSGKTVGEYIYDNLLDAPDLKIRGKLVSTIERKYYRSELEQILTAQKKYHPELSNSELFNKCISNLYPNNDIHRKALLSKDFVHLIINDIIFYQRPLKSKRSTVSNCPLEYRVYVDKVTGEKKKVPLKCIPKSHPLYQEFRLWQYVKNLRLFEKERFENGRLLTNVDVTEQFLPDEDKYVELFEFLNGRKTFKQDDILKFAGIKSAKDRVKYYWNYPQEKEYPGNETRYLIESRLKKIENVPDEWLNYEKIEELWHLLYSVTDKVEIEKGLQSFAAKYQLPDLFVEVFKGFPRMEREYGAFSKKAIKKLLPLMRMGKYWKLENINPDLIEKVQKIIDGEADDNINDGIRERFSEINEMSDLRGMPLWKASYLVYGRHSEAAEVIRWRTSADLDQYIKDFKQHALRNPIVEQVVLEALRVVKDVWNYFGEGREKFFDEIHVEIGRDLKNPADKRQKIANQIQENENTNLRIKALLVELFNDPEVQNVRPYSPVQQQLLKIYEDGVLNAERDIPDDIQKISRMANPTRNQLIRYKLWLEQKYRSPYTGEIIPLNKLFTSEYEVEHIIPRARYFDDSFSNKIISEAEVNRKKDRMLAFEFIKKLGGSTIDLNYGKKVSVLTVEEYQQFVKDHYGINPHSRLKMQKLLMDEIPESFIERQLNDSRYISKMVRNLLSNIVREENENSPVAKQLITCSGSITNTLKQEWGLNDVWNTIITPRFERLNKMGEQKYGEWVNKEGKPVFQIQMPLELQKGFNKKRIDHRHHALDALIVASATRSHVNYLSNEAAKTNAKDTRFDLRNRLCYKEKRGQNRNFTWRFYKPWNTFTEDAKNALNDIVVSFKSNHRVINKSTNRYFKWENLPGGMKKKRLVRQEKGDNWAIRQSLHKDTVLGKVSLRKVKPVSLSVALDSWNNIVDKALKKKIRSLKDQGYDKKLMLKYFKDRRNEYNGENISRVNVYYFDEEMAARRVDLDTSFNSEKRIEGITDSGIKKIIYAHLKNEKYHGQKDDKGKDISPYELAFSPEGIAEMNANIKQLNGGKPHCPIYKVRLAEPVGEKFQLGETGNKTEKLVEVAKGTNLFFGVYANDEGVRSFATVPFYLAVEREKQGLPAVPQENENGDQLLFWLSPNDLVYVPSEEDAHFANPKQIELDNSRIYKMVSSTGTQCFFIPHFVATPIVQTIELGPNNKSERAWDGQMIKKVCYKLSVDRLGNVEIE

SEQ ID NO: 283 - protein, 333 aa, Bacillus cereus
MMNPNNFTKEDFWRTIILYGLNQATYKIALGQSLIRFSEQQRNVVSMNELAEDFFDMYLERLKNGKPQLATPNRQTAMERIINSYNIGRLTRSQAIEKVEREAFNDVIDRFHTVDSLQVPMKFYEKTDKGIVIFDNVFEIFSDNNNFELRNELDARWDLLESAFEIKRTDSQLVNDIRKLYLANGYERTDITKNRSVLNGYQSNVCFYCGELMSDDDVHVDHVIPRQLINHDDIWNLVLSHGFCNQQKSDNLPDVNYIEKLIERNEYFIKSNHPISNKLKERLGNTPRRRRTTIDRIYEHAKLVLAPWKGIYGYNPATDPFYKTFIRNIVLSK

SEQ ID NO: 284 - protein, 1068 aa, Bacillus cereus
MRYVLGLDIGIASCGWAVINQEKERIEDLGVRIFDKAENPKDGKSLAAPRRDARSTRRTLRRKKHRMQRIKILLVKQGLLFKTELNHLYESATEFDVWNLRLDALERKLHPKEFARVLIHLAKRRGFKSNRKETTLSENGQILESISENQQIMEQQNYRTVGEMILKDKKFENHKRNKDGTYIGTVTRQQLQDEIQMIFHTQRLYKNDYATEEFESSYLEIWASQRPYASKDQIEKMIGYCTLEPKEKRTPKASWSFQYFVALQTINNLRLISKDKIEELSFEEKKQIMNLALEKPIVKYIDIRKLLSIPNDFQFNSLSYSADTVDTTLENKRCIELKEYHSINKVYKQVYGKNTPNLLPIDYDTIAYGLTIFKDDKDILEYLQNKYVNAKGKPIKNLAKKTYDDTFIQALLNLNFTKMGHLSFKALKNIIPFLEEGLSYDKACEKAGYNFKGTSYTERTKYLPVIPQNTNPVVHRALSQTRKVINAIIKKYGSPNAIHIETARELSKTFQERKEIDSRYQDNSKKNEHAIHKLKELGNINPSGINIVKFKLWSEQDGRCMYSGKYIEPHRLFEEGYTEVDHILPYSRSLDDSYNNKILTLGTENQRKGNKTPYEYMGNTSIWDEFETRVQSNKKINFKKQQKLLLQNFSYAREQEFIERNLNDTRYATIYLTSLIQQHLIFSESSSKKKVRTVSGIITSHLRSRWGFNKDRKEGHIHHALDAVIVAVTSNHMIQRVTKYYKLKELNKNLQAKQLPFPEPWEGFRLELEARISPNTQQYLKGIHFKNYADVNLSDIKPIFVSRMPKRSITGELHQETIRKFLGYNEKGKVLTAIKTKLEDIPFDANGDFPMYGKETDLYTYNAIKERYLSHEKDKRKSFQEPLYKPTKSGEIGPLIKSIKIMDTRTIVNPVNQGKGVVYNSKIARTDVFKKEDKYYLIPIYTIDLLKNILPHKAITAGKGYEDWTTIDSSFTFLFSLFPNDLIQIVPSKNKTIKARTTVSKKEILLPSLTGYFKGVHSGTAGITVETHDGSVIANVGSKQLLLFEKYQVDVLGHYTKIKEEKRMGMAI

SEQ ID NO: 285 - protein, 1078 aa, Bacillus cereus
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 286 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 287 - protein, 1069 aa, Bacillus thuringiensis
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 288 - protein, 206 aa, Bacteroides cellulosilyticus
MKKILGLDLGCNSIGWALVNEAENTEEISSIIKLGVRVNPLTVDEMQNFEKGKSITTNADRTLKRSMRRNLQRYKLRRDTLIEVLKEHGFITDSTLLSEHGNKTTFETYRLRAKAAVEEISLEKFARVLLMINKKRGYKSSRKAKGSEDGVLIDGMDVARKLYEEGLTPGELCLQILEAGKKNLPDFYRSDLQNEFDRIWNFQKLV

SEQ ID NO: 289 - protein, 349 aa, Bacteroides coprosuis
MKKILGLDIGTNSVGWAVVNTNQEGEPSQIEKLGSRIIPMSQDILDKFGQGQTVSSTASRTDYRGIRRLRERSLLRRERLHRVLHILDFLPKHYADSIGWDPRNSKTYGKFLPGTEVKLAWVPTADGHQFLFYSTYLEMLEDLKQTQAQLFETSQTPVPLDWTIYYLRKKALTQPITKHELAWLLLHFNTKRGYYQRRGELEDTPTDKLVEYHALKVVDVEVDPEDQSKKPWYFVHLENGWIYKRQSSEPLDNWKGLVKEFIVTTHLDKEGKPKLDKEGEVRRSFSSPKEDDWTLVKKKTENDLEKSGLTVGAYIYQTLLNKPNQKIRGGLIKHIERNYYVEELEQILR

SEQ ID NO: 290 - protein, 1504 aa, Bacteroides coprosuis
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 291 - protein, 1509 aa, Bacteroides eggerthii
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 292 - protein, 1526 aa, Bacteroides faecis
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 293 - protein, 1509 aa, Bacteroides fluxus
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 294 - protein, 1436 aa, Bacteroides fragilis; identical to SEQ ID NO: 160

SEQ ID NO: 295 - protein, 1512 aa, Bacteroides nordii
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 296 - protein, 779 aa, Bacteroides oleiciplenus
MKEGNQYDVACEYAGYRHSKSSLTREEIDNKVLKNRLEILPKNSLRNPVVEKILNQMVNVVNAVIDTYGKPDEIRVELARELKKGAKEREELAKSIAQNTREHEAIRQLLQTEFGMMHVTRNDIIRYKLYEELKDNGYKTLYSDQYIPREKVFSKEIDIEHIIPQARLFDDSLSNKTLEYRAVNIEKGNKTAYDFVKEKYGNDGLRRYLNHCEALFKDKKTKLKKLKMEDQDIPDGFIDRDLRNTQYIAKKALSMLSEISRRVVATTGSITDELRKDWQLVDIMKELNLPKYEALGFVETFKDKDGRIIKKIKDWSKRNDHRHHAMDALTVAFTKDVFIQYFNNKNAFWMSGSKEHANITAIKNKYFEKGKALAPIPLELFRTEAKHHLENILVSIKAKNKVVTNNINRTKKKNGENLKLQQTPRGQLHLESIYGSYRQCIIRDEKVNASFDASKIANVSKSAYRNALLKRLEAYDNDPKKAFTGKNSLDKNPVYLDENKMEKVPDRVKIVEFETVYTIRKPIDPKLSIDKVVDARIRTLLKKRLEEYGGDAQRAFSNIEENPIWLNKEKGISVKRVAIRGISNAQALHDKKDKDGNPILDKEGKGIPTDFVNTSNNHHVAIYRKPVVDKMGQVILDENGSPRYELGEDVISFFEAVARVNLRQPVVDKDYKRSEGWQFLFSMKQNEYFVFPNEKTGFNPKEIDLLNPENYALISPNLFRVQKIGLNDYTFRHHLETSIQNNSNELKFITWIRCGKNGINGVIKVRVNHIGQIVSMGEY

SEQ ID NO: 297 - protein, 653 aa, Bacteroides oleiciplenus
MKKILGLDLGSSSIGWALVNEGANDEEKSSIIKLGVRVNPLTVDEAQNFEKGKSITTNADRTLKRGMRRNLQRYKQRREALVEVLKKHEFITAGTLMSEQGNKTTFETYRLRAKAVEEEISLEEFARVLLMINKKRGYKSSRKAKGDEDGVLIDGMDVAKKLYDEDLNPGELCLQLLEAGKKTLPDFYRSDLQDEFDKIWNFQKQFNPESFCDTAKEEVRGKNRTQTWTILSKYFVWTEGDSVWNNEEARTEERIKEYKLVGIKRTTKGYEQKLENYRWRVQALSEQLNPEIIAIVLQEINGQISASSGYLGAISDRSKELFFNHQTVGQSLMSELDKNPNGSLRNKVFYRQDYLDEFNTIWEKQSLYHKELTVELKKEIRDIIIFYQRRLKSQKGLISTCEFEQREIIVEKDGKRKTKIIGCKVIPRSHPLFQEFKIWQTLNDVEVYVADRRTKRKQDRKSTTLFSDTEDILLVEGKRYLYQEEKELLAKELFVRENMKKAEVLKLLFEDPKELDLNFKQIDGNRTGFALFSAYSKMIEKYGYESVNFKNSADEIIEKLQIIFADLGWNTELFSIDLSKDDKELEKQPYFRLWHLLYSFEGDNTPTGNGKLIEALMRLCSVEKEYASVLANVSFQEDYGSLSAKAIKKYYLI

SEQ ID NO: 298 - protein, 1436 aa, Bacteroides sp.
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 299 - protein, 1510 aa, Bacteroides sp.
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 300 - protein, 1436 aa, Bacteroides sp.
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 301 - protein, 1424 aa, Bacteroides sp.
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 302 - protein, 1055 aa, Bacteroides sp.
MRIYRKDLAQDVDVTNELLKTEEDYVALFDWLNGKKEIDQKAFLKYPLFGLKKEVENYRWNYVQDKPYPCNETRSSMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERMDKIITGEYDEKIENRVREKAIHLADVSDFKGLPLWLVCYIVYGRHSEAKEITQWKSPADIDLYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVARQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNHFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKVRWYEQADKFAVGQTGNKSSKFVEAAKGTNLFFAVYESNILDKKTNTIIKKRNYATIPLNVAIERQKQGLPVAPEDENGNDPIFVLSPNDLVYLPTAADLANGIIAQPLDRGRIYKMVSCTGNEGYFIPARIANPILQTIELGSNNKAQKAWTDEMIKEICMPIKVDRLGNVLESSSSYKK

SEQ ID NO: 303 - protein, 1055 aa, Bacteroides sp.
MRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 304 - protein, 286 aa, Bacteroides uniformis
MLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 305 - protein, 1508 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKVKVVRLSVALDTPSMIVNKRVKNKVLELLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 306 - protein, 1210 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKALIPQHYNLTLFISS

SEQ ID NO: 307 - protein, 1504 aa, Bacteroides vulgatus
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 308 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 309 - protein, 1352 aa, Belliella baltica
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 310 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 311 - protein, 1430 aa, Bergeyella zoohelcum
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 312 - protein, 1281 aa, Bifidobacterium bifidum
MEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLAFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 313 - protein, 1121 aa, Bifidobacterium dentium
MSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 314 - protein, 354 aa, Bifidobacterium longum
AKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWV

SEQ ID NO: 315 - protein, 1124 aa, Bifidobacterium longum
LTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFPVSMLMVRLASIYNSSRSLVEGTLHGNIGLLMDSLTRRS

SEQ ID NO: 316 - protein, 166 aa, Bifidobacterium longum
MGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 317 - protein, 1138 aa, Bifidobacterium longum
MNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 318 - protein, 182 aa, Bifidobacterium longum
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 319 - protein, 441 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRM

SEQ ID NO: 320 - protein, 967 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 321 - protein, 1151 aa, Bifidobacterium sp.
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 322 - protein, 1092 aa, Brevibacillus laterosporus
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 323 - protein, 103 aa, Butyrivibrio fibrisolvens
MISVGQSRKDLEDLGYEFKLSFYKEDIIEYEKNGDILVERFLSRTMPQVRNYIETKPIDRPKYDKRNPVGLSKTSSIRKITMDILGNRFYVDKMSFNNVVGTQ

SEQ ID NO: 324 - protein, 177 aa, Butyrivibrio fibrisolvens
MLIAFSQMGYDAYHELTNKYIDFETGEIIDKEGFNELLNNDLVYKNTMYESKWLKIKGNIEKAAEKNKYWYQVNKKCNRGLCNQTVYGTRESDGDVYKISKIDIRTDDGFKKFKNIVDKGNESVFLMYENDPKTFELIMDIYKNYSDSKNPFVQYEKETGDIIRKYSKKITGQRFLN

SEQ ID NO: 325 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 326 - protein, 984 aa, Campylobacter coli
MARILAFDIGISSIGWAFSENDELKDCGVRIFTKAENPKTGESLALPRRLARSARKCLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 327 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 328 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 329 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 330 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 331 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 332 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 333 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLTNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 334 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 335 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVVLSSGMITQMLRNFWYLGFKNHKNYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANTKGSLVRTDLFVDKENKFHAVSIYKADFSTKKLPNKTPATTSNGETKEGIEMNENYNFCMSLYKNTPVSVKIKGMKEPIICYYHGFNTSGSKITYKKHDNNYHNLSEDEMVVFRKNDKESIVVGKILEIKKYSISPSGELSLIENEKRKWF

SEQ ID NO: 336 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKILTFKKLNDLKQGKTPFEAFGEDEKLWAEINERIKEYNGKKRFKIFDKFFKDKKPFDFTEQTLQDTRWLTKLVASYLNEYLLFLPINEDENTALGYGEKGSKQHVVLSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 337 - protein, 933 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSVIILHIAKHRGYDDSALKNENGTIIEALNKNKETMLKFKSVGEYFYKNFVQNKEVKKIRNTTEDYSNSVPRSLLKQELDLILDRQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEHLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANANGSLVRSDLFIDKKNKFHAVPIYKADFSTKKLPNKTPATTSNGETKEGIEMNENYNFCMSLYKNTPISVKIKGMKESIICYYHGFNTSGSKITYKKHDNNYHNLSEDEMVVFRKNDKE

SEQ ID NO: 338 - protein, 666 aa, Campylobacter jejuni
KGEKGTYFIEFKKYKEFIKALDEHSLSQDDLNEIAKDITLIKDEIKLKKALAKYDLKENQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFAKQNQEKLNKTPFEAFGNDSTKWQKIEVLTKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDEDYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 339 - protein, 190 aa, Campylobacter jejuni
MAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKKVMNAA

SEQ ID NO: 340 - protein, 985 aa, Campylobacter jejuni
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 341 - protein, 987 aa, Campylobacter jejuni
MARILAFDIGISSIGWAFSENDELKDCGVRIFTKAENPKTGESLALPRCLARSARKRLARRKARLNHLKHLIANEFKLNYEDYQSFDESLAKAYKGSLISPYELRFRALNELLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQRKFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKIVSNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 342 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDEGLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 343 - protein, 961 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 344 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 345 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFLLMKKERQKNSPLAFMFVALTRIINLLNNLKNTEGILYTKDDLNTLLNEALKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 346 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYPVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 347 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFHQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 348 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 349 - protein, 861 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFLCCANLYYGFCFKSITK

SEQ ID NO: 350 - protein, 462 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKS

SEQ ID NO: 351 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNKTPFEAFGNDGVKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLVVSKHDNKFETLSKNQKILFKNANEKEVIAKSIGIQNLKVFEKYIVSALGEVTKAEFRQREDFKK

SEQ ID NO: 352 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 353 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGLKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 354 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHTIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 355 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTFLNEVLKNGTLTYKQTKKLLGLSDDYEFKGEKGTYFIEFKKYKEFIKALGDHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 356 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKSLGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 357 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALVKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 358 - protein, 983 aa, Campylobacter jejuni; identical to SEQ ID NO: 236

SEQ ID NO: 359 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLVNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSEKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 360 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDNIKNSDNEEKSEILKAIKQNEEKLVNYQSVGEYLYKEYFQKFKENSKEFINVRNKKESYERCIAQSFLKDELKLIFQKQREFGLSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVVINEDKKDFLPAFNETYYKDEVTNPVVLRAIKEYRKVLNALLKKYGKVHKINIELAREVGKNHSQRAKIEKEQNENYKAKKDAELECEKLGLKINNKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPTKKQKRILDKNYKDKEQKDFKDRNLNDTRYIARLVLNYTKDYLDFLPLSDDENTKLNDIQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 361 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAEFECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 362 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGTILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 363 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFNESLAKAYKGSLISPYELRFRALNELLSKQDFARVILHIAKRRGYDDIKNSDDKEKGAILKVIKQNEEKLANYQSVGEYLYKEYFQKFKENSKEFTNVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 364 - protein, 984 aa, Campylobacter jejuni
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLNQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 365 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFLKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 366 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 367 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 368 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 369 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFIQREDFKK

SEQ ID NO: 370 - protein, 987 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRVPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYGVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 371 - protein, 984 aa, Campylobacter jejuni
MARILAFDIGISSIGWAFSENDELKDCGVRIFTKVENPKTGESLALPRRLARSARKRLARRKVRLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 372 - protein, 721 aa, Campylobacter jejuni
MFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNNTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 373 - protein, 512 aa, Campylobacter jejuni
MHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 374 - protein, 965 aa, Campylobacter jejuni
MKIIGFNLGIANIGWALRENDEIIDCGVRVFDIPENPKNGNSLALERRENKARMKIVKRKKARMLATKTFLKKELNVDLSKLFLIGSTQSIYELRAKALSSLISKEELSAIILHIAKHRGYDDSALKNENGTIIEALNKNKETMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQEINFKGLDYSKNNVENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKSEYLPLFEKTRFAKDISSPVVIRAICEFRKLLNDIIRRYGSVHKIHLELTRDFGISFSDRKKIIKEIEQNEQSRIKALETIKELKLEETSKNIQIVRLFEDQKGICPYSGLKMDLNRLDELVIDYIRPYNRSLDDSYSNKVLTFKKLSDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHDLTPLKIKELKNTYGDLDLAVKLGKIRKYNDKYYANANGSLVRADLFVDKKNKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIAVGKILEIKKYSISPSGELSLIENEERKWF

SEQ ID NO: 375 - protein, 759 aa, Campylobacter jejuni
MLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFESFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 376 - protein, 984 aa, Campylobacter jejuni
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 377 - protein, 1003 aa, Campylobacter lari
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 378 - protein, 372 aa, unidentified
DNESAINQIAYILTTQKADEGIRAELDSLPLSDKAKKAIVKIKPTNFKAFGHLSIKALQKITPHILEGMTYDKACEAAGYDFKKQSASLEQITNPVVKRAITQTLKVVRAIERKYGKPYFIKVETARDLAKNFKDRNAIKKENEENQGYNEDIKSIITNGYEASPKTKGGKQLLNHLKEFNVRLNKNADFNGQQIIKVKLYREQQGKCLYSGNPIDFETMLRDDNAYQVDHIVPFSRSNNDGITNKVLVFTEENQKKADRTPFEYFGTDERRWEKFVALVETTYKTRDVKTSDKATNAINYEYNGYAMKKKQNLLLQDYKNDSWNVRALNDTRYITRFIQNYLRQNVDFAEGEEKQRIIAPNGTTTAYLRKR

SEQ ID NO: 379 - protein, 1117 aa, Capnocytophaga ochracea
MKHILGLDLGSNSIGWAFVQQDFENKQGKIIATGSRIIPMDQGILGDFERGNTVSQTAERTTYRSMRRLRERHLLRRERLHRVLHLLGFLPPHYDAQIDFTKRYGKFIDNAEPKIAYNNGNFIFMNSFNEMVEDFKKHQPQLFYKKSNGEESRIPYDWTIYYLRKKALSQKITQQELAWLILHFNQKRGYYQLRGEEETENPNKEVAFHSLKVVDVEAEAPNKKGEIWYTIRLENGWIYRRTSKNPLDDWKGKTRDFIVTTDLNDDGTIKLDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLCSKKSTIANCTLEKRSYIDKETNERKDAPIKVCAKSNPYYQEFRVLQWLQNLRIYEIETDREVTAEFIETPQDYEALFNFLMSQKEIDNEGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYSGGQANFFDEIHIELGRELKKTAEERKQLSDKNQENENTNLRIKKLLAELKEDASIQNVRPYSLVQQELLKIYEEGVFSSTDEIEEDIQKIRKKVEPTPPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKCISEILSKIVRSDEKDEGVNSKNIIPCTGKITTALKQDWGLNDVWNELILPRFERMNQLTQTQLFTSYNDRLQKNLPTVPIEYSQGFQKKRIDHRHHAMDALVIACATREHINYMNNQHALDKSKDKKEKQQSRIDLHPL

SEQ ID NO: 380 - protein, 303 aa, Capnocytophaga ochracea
MSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKEKRTYATIPLNEVIERQKQGLPSVPERNEKGEPLLFSLSPNDLVYVPMEGEIAETIDFNNLSKEQKERIYKTVSFTGNQCFFVQEAVASPIVNKMEYSPLNKMERDILGIMIKEVCVKLKVDRLGNIIKA

SEQ ID NO: 381 - protein, 1471 aa, Capnocytophaga sp.
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 382 - protein, 1450 aa, Capnocytophaga sp.
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 383 - protein, 1435 aa, Capnocytophaga sp.
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 384 - protein, 1432 aa, Capnocytophaga sp.
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 385 - protein, 1426 aa, Capnocytophaga sp.
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 386 - protein, 1450 aa, Capnocytophaga sp.
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 387 - protein, 1437 aa, Capnocytophaga sp.
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 388 - protein, 1140 aa, Catellicoccus marimammalium
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 389 - protein, 1419 aa, Chryseobacterium sp.
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 390 - protein, 1065 aa, Clostridium perfringens
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 391 - protein, 1099 aa, Corynebacterium accolens
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 392 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVWVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPERAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRATWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 393 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMQRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSPDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLGSQLSVSDIDKASSEALWCALTREPDFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 394 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLKSATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 395 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 396 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDSFQRYRIAALISNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVRDGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKELAPELSKIIDRPGWLPAVNKLFSEGNVTVVRRDSLGRVRLESTAHLPVTWKVQ

SEQ ID NO: 397 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 398 - protein, 1084 aa, Corynebacterium diphtheriae
MKYHVGIDVGTFSVGLAAIEVDDAGMPIKTLSLVSHIHDSRLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNIQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRVTMDEEIDARSMESVAWMANELRSRVAQHFASRGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 399 - protein, 1069 aa, Corynebacterium matruchotii
MAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQVGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 400 - protein, 210 aa, Diplosphaera colitermitum
MSDILDKPIVLSLNRAWQVIGHRTVKQALVALNGGNADLPPALGLDIAYPKFDDGAWNFDRPLFLNPLPWSEWIELPVRDFDFAITTPRLRIRVPTVIVATQFAKMPVRIPRLTREAIFERDGGVCQYTGEHVGKHGGNLDHVVPRDRGGRDSFENLVWAKREINSLKANRLPHEAGLRLLRRPKAPAPLPASMTIREARHPDWRHFLTP

SEQ ID NO: 401 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 402 - protein, 921 aa, Enterococcus faecalis
MIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNRILFLEEKGFLRPRVLMKLPKYTLYEFPEGRRRLLASAKEAQKGNQMVLPEHLLTLLYHAKQCLLPNQSESLTYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 403 - protein, 1337 aa, Enterococcus faecalis; identical to SEQ ID NO: 115

SEQ ID NO: 404 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 405 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 406 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 407 - protein, 936 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETR

SEQ ID NO: 408 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 409 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENLGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 410 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 411 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLAMLPTETIDCLAKILTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 412 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDRLIGKDFQGELRASGLSLSAQQYNLLNDLTNLKIDGEIPLSPEQKEYILAELMTKEFTRFGVNDVAKLLGVKKERLSGWRLDKKGKPEIHTLKGYRNWRKIFAESGIDLATLPTETIDCLAKVLTLNTEHEGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANHETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 413 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINVQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTPFVKVSRYHYAVKEETGEKVMREIDFETGEIVNEMSYREFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEIMPAENQFKQKPYNNGAINLNIAKYGKEGKKLRKFNTDILGKKHYLFYEKEPKNIIK

SEQ ID NO: 414 - protein, 1150 aa, Enterococcus faecalis; identical to SEQ ID NO: 183

SEQ ID NO: 415 - protein, 1150 aa, Enterococcus faecalis; identical to SEQ ID NO: 184

SEQ ID NO: 416 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 417 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 418 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 419 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 420 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 421 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 422 - protein, 892 aa, Enterococcus faecium
MTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHKATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 423 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 424 - protein, 116 aa, Enterococcus sp.
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTELLSKGEIYKVTLHILKNVELVT

SEQ ID NO: 425 - protein, 1391 aa, Eubacterium sp.
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 426 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 427 - protein, 1142 aa, Facklamia hominis
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 428 - protein, 1347 aa, Finegoldia magna
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 429 - protein, 1348 aa, Finegoldia magna; identical to SEQ ID NO: 227

SEQ ID NO: 430 - protein, 1516 aa, unidentified
  source 1..1516: note = Flavobacteriaceae bacterium
MLKQQKDKIIGMNKKILGLDLGTNSIGWALVKQDLENKYGEIIGCGSRIIPMSQDVLGKFDAGISISQTAERTNYRSVRKLIQRNTLRRERLHRVLHQLDFLPKHYNDSIDFEKKLGQFKTDKETKLNYFVNQHGKHEFLFKDSFNEMVKEFKEEQPELFYIKNNGKETKIPYDWTIYYLRKKALSKKISKEELSWLVLNFNQKRGYYQLRGEIDEEKEKNKRYEKLYVSEVVKTNNTIKKTGEYLYDIYFDNGWKYEKQTTKPQDWLHKHKEFIITTTTLKNGETKRTFKTVDSEKDWIAIKSKTEQDIKESNKTVGAFIYDTLLKNPTQKIRGSLVKTIERKFYREEFEKILKEQIKHRPEINVNTAIGKENYTKCVTELYPRNEAHANNILTNDFNYLFTKDILFYQRPLKSKKSEIANCQYEYRTYIKKKEKTGKEERVKQPLKATPKSHPLFQEFRLWQFIHNLKIYIRETTVGNKPLFDVDITDTFFTSENDWATLFEYLNNKKEIEQKHVLEYLVSKKIISKSEKTDYRWNYVEDKKYPGNETRVDFINRLKKVENLNVDEFLTSELEFKLWHIIYSVTDKNEYEKALENFAIRQNIDKDSFVNSFKKFPPFKSDYGAYSTKAIKKLLPLMRLGKFWDGSEIPKVVVEKITDIKTRLTSVNYDESLFKKDEKKILETIVDDITPKQLLKSFVKLKGKNHLAGLNTYQACYLVYERHSESSDITQWENPDDIDSFLNHFKQHSLRNPIVEQVVTETLRTVRDIWKYYGNGSPNYFNEIHIELGREMKNPADKRKQMSAKINENENTNQRIKGILQELMNDGVQDIKPYSPSQQEILKIYEEGISQNPNVDYSKVSEDEITKIKKSNNPTLKEIQRYKLWLEQKYISPYTGKPIPLSELFTPAYQIEHIIPQSRYFDNSLSNKIICESEVNEDKSNKTAYEYLKTNGGSIVHGHHLLSLKEYEDHCQHYFKKNRTKLKNLLSEEIPEGFINRQLNDSRYISKLIKGLLSNIVREENEQEATSKNIVPVTGSITSKLKQDWGLNDKWNEIIAPRFKRLNKMTNSNDFGYFDEKINTFRIQVPDAISRGFNKKRIDHRHHTLDALVIACCTKKHIQYLNSLNNEIIKHELKPSILIKNAQGDYTKHFMLPWNNFPIDCKNAIENTIVSFKQNLRVINKTSNKYQSYKDENGNLRLGKDGKPKKGLTKQTKGNNWAVRKAMHEDTFYGEIVDGENKGKLKIKTLLDTSFDVKKIEDKVLDKSIRTILINYLKQDKYKNLSKPHEEAFSPNGIIEMNKNIISLNNNIPHKPIKRVTLKHEKGKKFSIKTLLDKKTKFAKSATGTNVFFCIYKNINGKIKYHTPSFEEIIEIQKQEFEIKYKSKLNVPETLFDKKESFELLFYLQPNDLVYLPNDEELKNRQLIDFNNLNKKQIKRIYKFTDGSGTTANFIPYQVAKVIFNLNKKEQAKSSFKYPIQNEFGVGSPQSKNQKSIEGILIKERCIKLKIDRLGNISKA

SEQ ID NO: 431 - protein, 1629 aa, Francisella sp.
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINIQILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYRSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAITTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLANNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNITIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 432 - protein, 1646 aa, Francisella sp.
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 433 - protein, 1629 aa, Francisella tularensis
  source 1..1629: note = subspecies Francisella novicida
MNFKILPIAIDLGVKNTGVFSAFYQKGTSLERLDNKNGKVYELSKDSYTLLMNNRTARRHQRRGIDRKQLVKKLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGLKDQDKKEGAKYSYKDLCNELKQKVTNAGLIDFLLELDPCRTIPPYLDNNNRKPPKCQSLILNPKFLDNQYPNWQQYLQELKKLQIIQDYLESFETDLKVLKSSKDQPYFVEYKSSNQQIASGQRDYKDLDARILQFIFDRVKASDELLLNEIYFQAKKLKQKASSELEKLESSKKLDEVIANSQLSKILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQVYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 434 - protein, 1629 aa, Francisella tularensis
  source 1..1629: note = subspecies Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTTIEFESSGFNKTIKEMLGMTLAGIYNETSNN

SEQ ID NO: 435 - protein, 244 aa, Francisella tularensis
ARKQNSEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 436 - protein, 501 aa, Francisella tularensis
MEIEKKIADTIWDASKQDFKFGNYRSFINLTPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYLLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQNVDKIFLL

SEQ ID NO: 437 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLS

SEQ ID NO: 438 - protein, 878 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSYKKYGTLNDEVNLICVTRDDNKNKGKRIFCLNDLANNYKLKQFETTDDLEIEKKIADTIWDASKQDFKFGNYRSFINLIPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYPLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSINKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 439 - protein, 292 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMVTILAKNIVDDNWQNIKQVLSAKHQLHIPIITESNAFEFEPALADVKGKSLKDRRKKALERISPENIFKDKNIC

SEQ ID NO: 440 - protein, 53 aa, Francisella tularensis
MNHSLLKSRYPDKVLEILKQSTIIEFESSGFNKTIKEMLGMTLAGIYNETSNN

SEQ ID NO: 441 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 442 - protein, 1629 aa, Francisella tularensis
MNVKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSIKDRRKKALERISPENIFKDKNNRIKEFAKGISAYSGDNLASGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIVEIRQLYEKVDSDIQAYAKGDKPQASYSHLIDAMLAFCIAADEHRNDGSIGLEIDKNYSLYPLDKNTGEVFTKDIFSQIKITNNEFSDKKLVRKKATEGFNTHRQMTRDGIYAENYLPILIHKELDEVRKGYTWGNSEELKIHKGKKYDIQQLNNLVYCLKFIDKSISIDIQISTLEELRNILTTNNIATTAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 443 - protein, 285 aa, Francisella tularensis
MTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 444 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 445 - protein, 1367 aa, Fusobacterium sp.
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 446 - protein, 1367 aa, Fusobacterium sp.
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKIIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 447 - protein, 1367 aa, Fusobacterium sp.
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 448 - protein, 1391 aa, Galbibacter sp.
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 449 - protein, 1186 aa, Gardnerella vaginalis
MEGNISYAIGIDVGLNSVGLAAIRLDDYGEPIRILKAMSVIHDAGIDPNGAKESDTRKAISGVARRVRRLYRQRRRRLQKLDFLLQSLGWPVVENKDLDFSDSFIPWIFRAKLADEYIADEEQRKQMLSVAIRHIARHRGWRNPYQSIKSMMQETEYSEFYNELLKNIEKLAPGVGCEGSTPAQLVRDYLLSQQGKASRRLRITTGGRRKNHPHSLDPVLPRKLMQSDNMLEILNIFNVQHIDDKYVREQIINAVFYAESPRGSAENRVGKDAITGKGKRALKASLAFQKYRIISTISNLRIRENSKERCLTIEEKQNVYKLLTTSIDKSSKRKSAEAPLYTWIDVADCLGIERYKLRGVGSQIGDGESVGNRPPMLNSELAILYANNKSLGQSLITWWLASNRTQEDKEALIEILSNTVDIEAIHDNPEYQDKYGSAIAFIDSMNETEIAALENISLPDGRAAYSLETLDELNKQMLETDDDLFEARKKLFNLPNNWRPAEAPIAEPTGNPSVDRVLKIVHRFLISAKNRWGNPERINIEHVRSGFQSKKMANSYKELLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEQSTYCKNHDISADSAINRVRAFIFPPNSYDKRGANQFKKEVIARLKQKVGDEAFDNRSIESVAWMANELHRRIDWYYNSQNYQTNNGISDISNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYSNSSVHQYEVNALLKLHVGDEIDSETIRRSSTPALYCALTRNPDYDVNNGFPENPGRTILLHNKKLNADDSITFFKAQAVQLFVREGSAKIGNSIHHLRIYEYFEKLKSGKIKKSYGMIRVFQNDLHRHIHEDLFSCDLPEQSISMRYADTKVAHAVQTGNANYLGYLVPGDEIIVDFSHITLSENIGKFVEFLNKIGADCTAYRHWVVVGTDTEKVLILKPSMISSEGIDKLYSNCERNNFDYSSYEKSINEILAGKGWRVSVNVLAQYKAATIRRNALGEVRWASRSHLPISWSWDTGENRE

SEQ ID NO: 450 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFIPWIFRAKLADEYIADEKQRKQMLSVAIRHIARHRGWRNPYQSIKSMTQETEYSEFYNELLKNIEKFAPGVGCEGSTPAQLVRDYLLLQQGKASRRLRITTDEKRKNHPNSLNPILPRKLMQSDNMLEILNIFNVQHIDDKYVREQIINAVFYAKSPRGSAENRVGKDAITGKGKRALKASLAFQKYRIISTISNLRIRENSKERCLTIEEKQSVYKLLTTSTDESSKEKSAEAPLYTWIDVADCLGIERYKLRGVGSQIGDGESVGNRPPMLNSELAIIYANNKSLGKSLLTWWLDANRTQEDKEALIEILSNTVDIEAIHDNPEYQDKYGSAIAFIDSMDETEIAALENISLPDGRAAYSLETLDKLNKQMLETDDDLFEARKKLFNLPNNWRPSEAPIAEPTGNPSVDRVLKIVHRFLISAKNRWGNPERINIEHVRSGFKSKKMANSYKELLDKRTKGKENLKAMMRNSLHLGMSDSISDADIRRYEAVQRQNGQCLYCGSEITYHTCELDHIVPRKGPGSTNTRENLVATCSLCNAQKCNTPFSTWCEQSTYCKNHDISVDSAINRVRAFIFPPNSYDKRGANQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYNNSSVHQYKVNALLKLHVGDEIDSGTIRRSSTPALYCALTRNPDYDVNNGLPENPNRAILLHDKKLNADDSITFFKAQAVQLFVREGSAEIGSSTHHLRIYEYFKKLKSGKIKKSYGMIRVFQNDLHRHIHEDLFSCDLPEQSISMRYADTEVAHAVQTGNSNYLGYLVPGDEIIVDFSHVKLSGNIGTFVEFLNKIGANCAAYNHWVVVGTDTEKVLILKPSMISSEGIDKLYSNCKRNNFDYSSYEKSINEILVGKGWRVSVNVLAKYNAETIRRNALGEVRWTSRSHLPISWSWNTGENRE

SEQ ID NO: 451 - protein, 1258 aa, Gemella haemolysans
MTEENPDIRKVFLAIHHILKNRGHFLLQGQSFKEGNLNNLIKELLNLDILHISIEITEENINKITEIALEKKTLTDKVNDLKKIYPKEKQLLEAFRLIFGGKTSLDKLFAIDEYKELDASVKSVSFKEKIYEEVRHDYEQVLSNYIELLDLAKLVYDSIILSDIKKEGKTLSESKVELYHKHREDLTKLKTLVKNDSKLSEDKKVELYSAIFKEDKDKGTNYVNYIRKSEEGKGCNYEDFKKFLVKELAKLEESSAKEEILRDLELELFLPLQRTKDNSVVPYQIHKEELVKILDNAAKYHKFLNEKDDSGYSIIEKVIQLLEFRIPYYVGPLNSSKKAKVDGFAWSVRNKGYENTPVTPWNYEKVIDESASAEKFITNLTNKCTYLKGEDVLPKSSLLYSEFALLNELNALKYDGNRISLEARNVIIEKLFKEQGKKVTKTSIKNLLKAEGYIDGKGEITGIDITVKNDLKSYRDFKKILGDKFNTEHVENIILWITLYGESRKLIKAKIEAVYGDIYSKEEIAKMSRLVYKDWGRFSRKLLTELVSKKLYNEETGECLNIIGAMRQNNILFMELLADRFDYSQQIIDYNKELQKEVTEITPEILDDLYVSPSVKRSIWQTVRIVEELKKIIGCAPAKIFVETTRSNQDKKKPTDSRKKQLELFYKAVKKDVKDLEKEIGSLNFDKLNERLSSVEPSKLKAKKLYLYYTQLGRCMYSGETIDITQLNTTAYDIDHIYPQSKVKDDSFTNTVLVKREYNAAKTDRYPLGSDIQTPSNRRFWKFLKEKGLITDEKYNRLVRTEEFSDEELTGFIARQLVETSQSVKAVAGILGELNPKTSICYSKAENVSSFRQNFGKIKEGNRKSDNTEQLIKVREINDYHHAKDAYLNVVVGNVYDTKFTRNVFNFIKDKKDGRKYSLNNVFYENVSNSNNVAWELNKTVHQVEKVMNNNNILVTRRTSEQKGGLFDATVYKAKVAAKAKEGVYYPLKTSDPVVNDVTKYGGFTKVKIAYYSIFEYTLVNKKGEEKITRIIPIPIYVSQNIKDDSTLLEFGKTQINIKSGEEVKDFKLKYRKLCIGDLVKINNFFNFIGGKTNDSFVYDGAVQVTLDTESERYIKTLSKYQNWKKENKDGELWESITKEKNTELYNLLVEKMNSGIFIKKKPNKFNELNSEEIRNNFSSISLEEQAKVLLEVLNLLTNKKSIFDLKSINITAARGKISFNLSNLSQFSIIEQSVAGFYEKEITIIGDKENDMENNNC

SEQ ID NO: 452 - protein, 1054 aa, Haemophilus parainfluenzae
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 453 - protein, 1052 aa, Haemophilus parainfluenzae
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMIGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 454 - protein, 121 aa, Haemophilus pittmaniae
MLNRRYAAKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLN

SEQ ID NO: 455 - protein, 203 aa, Haemophilus pittmaniae
MVNREREKDLYDALKARLEAFNDDPAKAFAEPFIKKGGAIVKSVRVEQVQKSGVLVREGNGVADNASMVRVDVFTKDGKYFLVPIYTWQVAKGILPNKAATQYKDEEDWEVMDNSAIFKFSLHPNDLVKLVTKKKTILGYFNGLDRATGNIAIKEHDLEKSKAKGGIHQGVGIKLALSFEKYQIDELGKNIRLCNPSKCQSVR

SEQ ID NO: 456 - protein, 1052 aa, Haemophilus sputorum
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 457 - protein, 1338 aa, Helcococcus kunzii
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 458 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 459 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 460 - protein, 344 aa, Helicobacter pullorum
MKILGFDIGIASIGWAFVENGELKDCGVRIFTKAENPKTGDSLAMPRREARSVRRRLARRKGRLETLKRLLAKEWDLCYEDYIAADGELPKAFMGKNLTNPYVLRYEALQRLLSKEELVRVVLHIAKHRGYGNKNAKITKSEESKREQGKILSALATNASVIARYRTVGEYFYKEFCEVIKNPQGLNTNENCTQPKVRVLKPIRNKGGEYTNCILQEDLQRELRCIFEHQKGFGFSITQEFQDKILKIAFYQRSLKDFSHLVGKCTFYPDEPRAPKFSLSAIEFITKAKAINLLASIAKESGEVWDKEQWRERLDSVFSAVCERGINTIPSSSHFLNIFDILYL

SEQ ID NO: 461 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 462 - protein, 1354 aa, Indibacter alkaliphilus
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 463 - protein, 1397 aa, Joostella marina
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 464 - protein, 1060 aa, Kingella kingae
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 465 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 466 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 467 - protein, 315 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDMVDCKINPNAVRTKKISFL

SEQ ID NO: 468 - protein, 236 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSSSIFKSSATMITNS

SEQ ID NO: 469 - protein, 1389 aa, Lactobacillus casei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 470 - protein, 412 aa, Lactobacillus casei
MIKDNSLDNRVLVHPLVNREKDTIFASTRFAKQTNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNPKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKK

SEQ ID NO: 471 - protein, 234 aa, Lactobacillus casei
MKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 472 - protein, 566 aa, Lactobacillus casei
MQILTDEVLKQKIAELNAHELKASGIYAAIDDAYTSPSNKKALRQVLSVIDDITNAAGQAPNWLYIETADGDGVPGKRTNSRQRKIQEIYVNAAQELITSSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKK

SEQ ID NO: 473 - protein, 1363 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 474 - protein, 1360 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 475 - protein, 700 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKAIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLNAGMINSLANIRYRGWGQFSHKLLNELTLSTGRTVFEA

SEQ ID NO: 476 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDD

SEQ ID NO: 477 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSHAKVDD

SEQ ID NO: 478 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 479 - protein, 1128 aa, Lactobacillus casei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKDIQLIFMGAISERTRPILPL

SEQ ID NO: 480 - protein, 1366 aa, Lactobacillus casei
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 481 - protein, 1354 aa, Lactobacillus coryniformis
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 482 - protein, 544 aa, Lactobacillus crispatus
KYYLYFMQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 483 - protein, 298 aa, Lactobacillus crispatus
MDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 484 - protein, 279 aa, Lactobacillus crispatus
MNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYYTR

SEQ ID NO: 485 - protein, 538 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 486 - protein, 206 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKRK

SEQ ID NO: 487 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 488 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKNSFQMNKNDQDFLF

SEQ ID NO: 489 - protein, 347 aa, Lactobacillus crispatus
MVNLKSLVLILKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 490 - protein, 534 aa, Lactobacillus crispatus
RDAYTDKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 491 - protein, 278 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYY

SEQ ID NO: 492 - protein, 277 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKY

SEQ ID NO: 493 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 494 - protein, 669 aa, Lactobacillus delbrueckii
MAKPKDYTIGLDIGTNSVGWVVTDDQNNILRIKGKKAIGARLFTEGKVAAERRSFRTTRRRLSRRRWRIKMLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERNILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVKKRHADLAKAMKLTGIKKRSELLDPEELKKGISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQR

SEQ ID NO: 495 - protein, 544 aa, Lactobacillus delbrueckii
MTGCADYDVDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGEVDVIRKILKGLHANADITNLAELGFGTAALGALVSTGGIKISDDAVFIYQSPTGLFERRVKVSDLLK

SEQ ID NO: 496 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 497 - protein, 1313 aa, Lactobacillus fermentum
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 498 - protein, 1327 aa, Lactobacillus florum
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYDEYIDGDKPTIDTFYTNIKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYEHVCKKQRRVTLKKLSDCLMARGDFPMGAIFTGTTDQKNMNNTLKTYQDFQEIFGDEIDNPDRQVDFEKMIEWSAIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 499 - protein, 1386 aa, Lactobacillus hominis
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 500 - protein, 270 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKYLIINLNIMTFC

SEQ ID NO: 501 - protein, 255 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNTFDDERDGYAADLGDRINLLILLKQIYDASILESMMSQARVSIDGHKYISSAKVCAYEKHKSDLKRLKSLIKKYLPSEYNNIFRKITEKDNYVAYSKSNITNNKREKALKYVEYVDFTKYLTKKLKTIKTQDAEDDKEIFEIKGELEKQSFLPKQRTLDNSIIPYQLHLME

SEQ ID NO: 502 - protein, 343 aa, Lactobacillus iners
MLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKIDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKYKIDEINKSYYQHDKFNYKSMIDSLYVSPATKRILWQSLKVVHEISKIMKHDPEKIFYRNGTFQRRSS

SEQ ID NO: 503 - protein, 447 aa, Lactobacillus iners
MLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDSKTNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVISKYTNSVFGKSMLISDKYRKDIFKSVDKSILEFNSLNTIAKADNLLKFVTSMRPAGSVDALKMVGLIERIRKSNVISNFNEFKLINQSVTGLFENEEDLLKL

SEQ ID NO: 504 - protein, 667 aa, Lactobacillus iners
MQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 505 - protein, 1395 aa, Lactobacillus jensenii; identical to SEQ ID NO: 118

SEQ ID NO: 506 - protein, 1382 aa, Lactobacillus mucosae
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 507 - protein, 1382 aa, Lactobacillus pentosus
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 508 - protein, 1361 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 509 - protein, 1358 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 510 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 511 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQEHYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 512 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 513 - protein, 1352 aa, Lactobacillus ruminis
MNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 514 - protein, 1339 aa, Lactobacillus salivarius
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 515 - protein, 629 aa, Lactobacillus salivarius
MERYHIGLDIGTSSIGWAVTGDDFKIKRKKGKNLIGTRLFKEGNTAAERRGFRTQRRRLNRRKWRLKLLEEIFDPYMAEVDEYFFARLKDSNLSPKDSNKKYLGSLLFPDISDSNFYDKYPTIYHLRRDLMEKDEKFDLREIYLAIHHIVKYRGNFLENVPAKNYKNSGASIGFLLEEVNNLYKDIVGDENVTILNSEKFEDVEKIILDDGIRNLDKQKGVGKLLVEDKKNKNLVTAFSKAIFGYKFNIEDLLLVEGDEKSKLTFNDENIDDIFNELSHSLDDRRMDLLTKTREIYFKFKLNMIVPTGYTLSESMIEKYEIHKAHLKMYKEFINTLNSKDRKILKNAYTDYINNEKAKAANAQENFYKTVKKTIKDNDSDIVKKIIDLIDEGNFMPKQRTGENGVIPHQLHQIELDRIIENQAKYYPWLAEENPVEKNRKFAKYKLDELVTFRVPYYVGPLVDKTESNKNEKETKFAWMVRKSKGTITPWNFENLVDRTESANRFIKRMTSKDTYIIGEDVLPASSLLYEKFKVLNELNNIKVNEKKLDIEQKQNIYLKLFTTTKNVTKKNLATFLNCSIESISGLSDDKKFNSSLSSYIDLKVILGDIVDDYSKNEDLEKIIEYSTIF

SEQ ID NO: 516 - protein, 897 aa, Lactobacillus salivarius
  VARIANT 822: note = X can be any naturally occurring amino acid
MLIESDEKNKLTFNDENIDDIFNELSHSLDDNQMDLLTKTREIYFKFKLNMIVPTGYTLSESMIEKYEMHKAHLKMYKEFINTLNAKDRKILKNAYSDYINNEKAKAANAQENFYKTIKKTIKDNNSDTAKKIIGLIDEGNFMPKQRTGENGVIPHQLHQIELDRIIENQAKYYPWLAEENPVEKNRKFAKYKLDELVTFRVPYYVGPLVDKTESNKNEKETKFAWMVRKAKGTITPWNFENLVDRTESANRFIKRMTSKDTYIIGEDVLPASSLLYEKFKVLNELNNIKVNKKKLDVEQKQHVYLDLFTTRKNVTKDNLATSLNCDVESITGLSDNEKFNSSLSSYIDLKAILGNAVDDCNKNKDLEKIIEYSTIFEDGNIYKEKLSEISWLTDEQIEKLSNIHFKGWGRLSKKLLTQITNENGERIIDALWNTSNNFIQIISDESIQAKLAEINGEYADKSNLEDILDEAYTSPQNKKAIRQVMKVVEDIEKAMKCKPTSIAIEFTRRKGKSKLTNTRYKKISETYEKITDELISEYELGKLQSKLDSKANNMRDIYYLYFMQLGRDMYTGEKINIDELHQYYDIDHIFPRSFIKDNSLNNRVLTRKEINNNEKADRTAADLYAVKMGDFWRKLRKQGLITEKKYKNLLTRTDSIDKYTKQSFIKRQLVETSQVVKMAANILQDKYSNTKIIEVRARLNSDLRKEYELIKNREVNDYHHAIDGYLTIFIGQYLYKTYPKLRSYFVYDDFKKLDSNYLKHMDKFNFIWKLEDKKAEDVYDNVNNEFILNVPKMKDYIQKIYNYKYMLISKEVTTESGAFYXZTKYNAKTINLIPIKKDKPTNIYGGYKGKVSSYMMLVKIQKKKEVIYKFVGVPRLWTDELDRLIDTDEKKALLKK

SEQ ID NO: 517 - protein, 1419 aa, Lactobacillus sp.
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 518 - protein, 1289 aa, Lactobacillus versmoldensis
MRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 519 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKNFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGGSSDKTLEQAIEKQNIQWEEKFQRIINASMNICPYKGASIGGQGEIDHIYPRSLSKKHFGVIFNSEANLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 520 - protein, 907 aa, Leptospira inadai
MAKSIEEIRSIQNEFVVEYSILLKKIKKGEIDKKNDVYKVYQNTIKSSERLEQVLKERLGFQNVSKSYFNNPYSIAQLYNLISVDRSGFSKVCRSCQEENHWRSTLIDTDRGPQAQASKQVSDTGRPFDGQLAMLLDRIAFEIVKLKRIEIERLLSNKNSSKIEVVEIPLLIEENSFNFRYELAELKKLSKKKKDQLKKSVEEFDTKLNSKQERIKAASRELCPYTGKKISKGEIDHILPRSWTQKQFGTALNAEANLIYASREGNQSKGNREYGLNDLDEKYLNIIFGTKEVDSIQRNISDTIDRLDIERGTTRIVFDRLAPNERDCLRHALFIKSLRPKVFELLSGQLKARVNGTQLYLAKRIRSLLLKNQDFITKSLIIKVPSFSFYEPRTVDLPYMRKELAEKFPNLGKQNPQPTGSHIIDAAMVMAYAVETDSGNLSFGSKDKSEGFDSESLSRFLPSNIQFLSIKSKDKTDSKYPYKKPLFKDGVFGERFLPILIAEKGLRVGYTLENSLEVNSENPEEFFNVLKPYLLFKRKPIESNYQTLVAFAQKDKRGYIVLPVNKPKALESISQRKSDPHTSILKNILYTVSRESIPSLIFDKNTLIPEIKSNKVNWGDKLEKKFRIKIEIKLYGKKIADGFIRYPGKTEWEKLLLTEPLKGLVKNKTLTPKWFDSLENLAGLDDHFKDTSNPEAKHKRKSNHYALPVPKGPSGGFRIRRNSFDGYKVYQLYSVDGNSFHAFKIENGWTGKTLLLDIYQNSGNLHSLDYDYENTDISQTALFSKFYKIEFSKEETQKINSKGIKSLYVAPGSSSRQYIRVIFDKQTFSKFIKFQSKFWEFDLITPLPKDKAKDLIESILKIFPEDLRPKKPRNDIHIQNISHDSVQVEYIADGKTQGFGQYFINQN

SEQ ID NO: 521 - protein, 418 aa, Leptospira inadai
MILKSPIAIDLGAKNTGIVYTTYQPNALPTEIHGATIISDNLKLSQVDRRAKRHQRRNYTRMKLARRLVYLIIRYHYRIPEQDLTPEVKTSLQSLLTRRGYTFQSIETEGNELGQAPWGEIEDYFPNVQDYEKSLPIQTVLYHFFSSENLELNKLVPSKEPETKEDKNILKYIREQKEAFESEQNNGARHRLKYFEEIKEDFPRKIKLMECLQKNKIEEKKFLNLIQNISNLQIKPLRAYFNDKDMKEKEIWEPRRLHTYIARWIRSWHIDPKNSSKRLIRQKLLSQLENGKLKIIRDTSIYSPSKDIISFLEEIDPKDTIPPYEDQNNRHPPRCQNLWLDGKILDRYFPGWEQSLWKLIRNEKNNPFEQLITKDFRTDDTISEGKSLSEQIQIYERSHSNIKLDVRAVILQRFLDRS

SEQ ID NO: 522 - protein, 125 aa, Leptospira inadai
MSAYDRSANLDPWSLRLQGKAKKEIKTTESLSKTDLQKASDAYEKIKEILSESDTDQFIKLANRYYLEVADIKKGMWLPTAPERKHKEIPKSIAHEENQDISLFHKCNTKTGSKKRISQVSLEMF

SEQ ID NO: 523 - protein, 1355 aa, Leuconostoc gelidum
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 524 - protein, 883 aa, Leuconostoc pseudomesenteroides
MIGVRLFEGADTAAERRGYRTTRRRLSRRRWRLRLLNDIFASELSKIDENFLPRLKYSWVNKNDTDNVHFGVGVFDNSEQEKAFYQDYPTIYHLRQKLMTDNRQHDLREVYLAIHHIVKYRGHFLNSGEISANSSFDAQKFLELLREFDNTFYPDAVKFLNLDQLDLPDKISSEISDSKISKSERVDRVLQHVQLANSGAKKILKAILNAVVGNSVDSVAMFSLSDLDKEEKKKINHPVTDSKPFKYSDKEVEAKLDELSNLLQDEQKIEFLSLLKLSFDGLTLKMLLGNAKSVSEAMVERYKVHKDDLKFIKENILNSFSKDKKKEFDKYYEAHLAEKDVDNVDKYFKKIIDDSIISKDKKIELLQKIDDHDFLPSQRSKINGAIPHQLHRNELDKIISQQSKYYPFLADSYTQNGKTETKLAGLVNFRVPYYVGPLVSKENADRNNPDGGQNHWVEFKENTSLSNLTPWNFNEIVDKDKSAAKFIERLTGMDTYLIGEPTLPQNSLLYQKYNVLQELNNIRVDNHKLDVKIKQDVFEHLFKTQNSVSAKDVKNYLIANGYAAPSIQITGLSDTNEKTFNSKLSSYNYLVDKLGRTFVESVKSDVLEKIIELQTVFEDKTVLLRQLSMISELTLAQANQLAEKHWTGWGRLSRKLLSSKVVDVNKITNSTFYPATSRQTIIDTLYHTQLNLMEIINNAEDLYGVRQWISEQNKSDSSDTNDVYDQIQELAGDKKIKRGITQSFRILDDIVKAMGGEPERVYLEFARENQQSGVSFSRKNLLSKLYENDSLKQTFKELKSQLESETKENLQNDRLYLYYLQQGRDMYSNDELNIDQLSSYDIDHIIPQAYTKDNSFDNRVLVSSKANRLKRMLLWYPVKLSKK

SEQ ID NO: 525 - protein, 468 aa, Leuconostoc pseudomesenteroides
MKDQGFISKRKFENLTRRGDFSEQQKERFIARALVETRQIIVNVSSLIDSHFNHTKAVAVKSNMTTDMRHYTKVPKNRDINDYHHAHDALFVATVGQYIENKGFMKAGKLSDSVGNEYNRYTKKWIETARKNTNYGRVNPFGFVVGSMQTATRGKLDYETGELKVVKNNYWSKDDLDYLLKVVSYKKILVTTKLQDNKGAMYDANLISAKGSGKKKAQLQISKSKNIDLYGGFNKLQNEYSVLILNHDEYRWLSIPMYARNSSEQYLHDKYPDAKVILNHILVGQPILLSNSSDPQKSKFASLRIATGGDYHNNFEFVPSVDVKKILDNIYLNHSVTDDEYKKVFESLLATLHDKFVFGIHQVMYNKIFDNKYLFDKMPDEAKRNVINSLLKFMNISKNQLGAVGKIGGKVNGVLYGFKTETEKGTSAGQLISNGKMQPHDIFIFQSPTGIFERRVTVAELANVIKDE

SEQ ID NO: 526 - protein, 1103 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 527 - protein, 1337 aa, Listeria innocua
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 528 - protein, 953 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 529 - protein, 232 aa, Listeria ivanovii
MMSKLILGLDIGISSVGWGVLDESTNEVVDAGVRLFEEATRNGNEDRRGFRSARRLKRRRQHRLERAKGLIENNGFSCTDINKFNPYQARYNAIFGEVTKDELAAALFHLVKRRGTTIDAPEEEVKDVENELSTKMQLEKNAKKLATKYDYICEIQLEKLKENKVVRDHENRFRTEDYVKEARAILENQQEYYPEVTNEFIESYMALIETRRMYYDGPGSEKSPTPYGQYFI

SEQ ID NO: 530 - protein, 300 aa, Listeria monocytogenes
DDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHD

SEQ ID NO: 531 - protein, 782 aa, Listeria monocytogenes
  VARIANT 722: note = X can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 532 - protein, 1334 aa, Listeria monocytogenes; identical to SEQ ID NO: 114

SEQ ID NO: 533 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 534 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 535 - protein, 1099 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGIPAN

SEQ ID NO: 536 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 537 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 538 - protein, 874 aa, Listeria seeligeri; identical to SEQ ID NO: 180

SEQ ID NO: 539 - protein, 1087 aa, Listeriaceae bacterium
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 540 - protein, 1345 aa, Marinilabilia sp.
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 541 - protein, 1091 aa, Mobiluncus mulieris
MDSRKYRVGIDVGTNSVGFAAVEEDDSGSPTRFLNTMVVIHDSGVDSEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 542 - protein, 1233 aa, Mycoplasma canis
MEKKRKVTLGFDLGIASIGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTNANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNELLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISTNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNPDTSKTPKRLMFGIKSIMNNYEQVDISPFGINKKIFE

SEQ ID NO: 543 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTIESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTSANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDAILPKLLDNNEGWNLEAIKNYDEEIKSQIEDNSFLMAKQDKKYLNDNFLKDAILPPNVKVTFQQAILIFNKIIQKFSKDFEIDKVVIELAREMTQDQENDALKGIAKAQKSKKSLVEERLEANNIDKSVFNEKYEKLIYKIFLWISQDFKDPYTGAKISANEIVDNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDDKKMFKVIAMNGAVTSFIRKNMSYDNKLRLKNRNDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKLSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 544 - protein, 1233 aa, Mycoplasma canis; identical to SEQ ID NO: 247

SEQ ID NO: 545 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEENAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKSHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGMAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDKFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 546 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMLSVEDIDMIKYEWAGKEPNVYGVGLSGLNIEESAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFDDKYEKLIYKIFLWISQDFKDPYTGAKISANEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 547 - protein, 1239 aa, Mycoplasma cynos
MEEKRKVTLGFDLGVASVGWAIVDSETNEVYKLGSRLFDIPDTNIDRRAKRGSRRLVRRRSYRNQKFYNLIKRTKTFGFLDKEAIEKEFVLLSIKYPNIIELKVKGLQEEVSKSEAVWILHDYLKNRGYFYDDKEEKDDLENPSIESMPSYKLYEFYKEYGYFKGALSSPTESEKNKDSDLEKAIFFNFSNKEWTKEINHFFKIQKNIFSEDFKAKFMEFFSFIRDISKGPGSENMPSQYSIFGKYGDDGMGGKYQHIWDKNIGKCSIFKDKVRAPKYLPSALFFNLLNELSNIRLYSVDKREKSVLWRLSSKDKINIILNILQIILFKNDGKISNLDINKIVKNESIKSIILNEIDLDLIKDMWFEKEPNVYGIGLSGLNIEENKKENRFKFQDLKIFSVFIDLLKKSNINIEFNNEKDIIHNLKLLDELYFFLITQKYSRDKYGSIKKFILNNKSFNIDNLDEKLNIFLSISDDEFDNHNSKTHSLSKEAIYFIFPKLLHNNEGWNLEAIKNYDIDVREEISKHSFGIKKQDKKYLDDAFLDDAILPPSVKVTIKQSILIFNKIIKKFSNKFQIDNVVIELAREMTQEKEMDAQKSLNRLKKSRKKIIEERLNANNIDSKMFRDKTGEISPNYIYKIYLWISQNFKDPYTGENISANDILKNNVEIDHIIPYSLCFDDSSSNKVLVFKHSNQSKGNFLPFDMISTFSENSVWNWKEYTQYVEKTFKTNLESILDKKERVKKADNLLTSSYDGYDKLGFLARNLNDTRYATILFRDQLINYSENHLIDSKKMFKVIAMNGGVTSFIRKNMSFDSGLKVKDRSIFSHHAYDAAIIALFSNKTKILYNLINPSLDGIISKRSEGYWVLEDRLTGEIRKLNYNDWQSIKNNVEVKKIAREIESHLSNLDNVVMFSRKSKRKTNKELYNETLYGIATRIDENGIKNYYKKEKFNILEDENIYLRLLNERENFIINRSNPEVIDAIIEIFETIDKNKIPARDVAKNIKYTDNKIKYNLYLKDYMRKLVDEFPDKFRKDFIEQMIAKKIFILFNPIKNTTRKIKSLRSINNNKIEDIRKKQVLEKFNTAKNEPRSFYESLNSLGAIIFKNNLNIYKKMSISSQIATFGDKNWKIDDINTYNKEKLNKYKEIYGIDETYDFYSFIFPGTILLDEKNKEFLYISSIQTLKDKIELKFLDRIEFEKKNVNSNLKPKIKREIISTKKLMSDYKIIKISPLGINKKIFE

SEQ ID NO: 548 - protein, 1269 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 549 - protein, 1224 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKRRKQIGS

SEQ ID NO: 550 - protein, 1269 aa, Mycoplasma gallisepticum; identical to SEQ ID NO: 138

SEQ ID NO: 551 - protein, 226 aa, Mycoplasma iowae
MSNKKKITIGLDIGVSSVGWSILREDNVLIDYGSRLFPDAANAKDGKLENEARRSHRSMRRRIRRIKTRKNDLIKLLIKYNIISDQDELAKILEQGIVNETGNVPIVEIKYKGLKEKLSKEELLICLYHYIHKRGYFYITEEDLKENGENINRLPTEIQYDFYMKNGYYIGNEDNQKFSNLIWVKEIEKFLSKQSLDSNFVDEYISLFRRVRDYSDGPGSEKSPTP

SEQ ID NO: 552 - protein, 1304 aa, Mycoplasma synoviae
MLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 553 - protein, 1401 aa, Myroides injenensis
MKRILGLDLGTTSIGWAYVHEAENVNETSSIQKVGVRVNPLTTEEQTNFEKGKPITTNASRTLARSARRNLQRYKLRRDNLIQILKENNWINNTTSLTETGNHSTFETYELRNKAASEKLTLDQLSRVLLMLNKKRGYKSSRKVNSKEEGQLIDGMEVAKKLYHEQLTPGQLSLQLMNQGVKKLPDYYRSDLNQELESIWNFQQQFYPNILTDKFKEEINGKGLTSTSSAFWNIYNFNTAENKGSRDEKKKQALQWRSEALSKQLSKEIVAYIIADLNGQIYNSSGYLGAISDRSKELYFNNLTVGQYLFKQLKSNPHTSLKNQVFYRQDYLNEFEKIWETQSKFYPKELTAALKREIRDVIIFYQRKLKSQKGLISFCEFEQKQKTINGKTKTIGHRVIPKSSPLFQEFKIWQQLHNVVLRNKKTNEIVSLADEQKVHLFEELNLKGKLKSNQVLKLIENKPKDWELNYTELEGNNTNKALYNAYLDILDIEGYDVRNELKVKLNKDDIELSDLDVNASEIKEMIFSVFKHLGINTEILEFDATLEDKVFEKQASYQLWHLLYSYEEDNSPTGLDRLYNLLHKKFGFKLNHAKLIGNVLFQDDYGSLSSKAIKNIFPYITENNYYTACELAGYKHSKHSLTKEENETRELKNRLTILPKNSLRNPVVEKIINQMINVVNTLIDEENNILIAQGKEPNFQFDEIRIELARELKKNAKEREELTKSINKSKTDHEKIIKILQKEDGIKNPTRNDIVRFKLYSELKNNGYKDLYTNEYIERKDIFTKEYDIEHIIPQSKLFDDSFSNKTLVRRNVNLKKGNQTAYDFILCEYGQEKANEFETRITNLYNLGKDEGISKSKFKKLLMQESEIGNGFIERDLRETQYIAKKAKSLLLEITRNVISTSGSITDRLREDWGLINVMKELNLQKYRDAGLTEFVKMKDGNKKEVIIDWTKRNDHRHHAMDALTIAFTKHNHIQYLNHLNARKNVNNELHNNIIAIEKLETTLVSDERGNKKRIFKEPIANFRTIAKSHLEAILVSHKAKNKVVTKNINKISGKKISQQTLTPRGQLHKETIYGKIRQYVSKQEKVGPKFTIEVIEQVSNPTYRNLLLKRLEENNNDPKKAFGGKNSLNKNPIYINLEKNIKVPEVLKLVWLEDNYTIRKEISPDLKIDKVIDQGVKQILQNRLAQYKGDSKLAFSNLDANPIWLNEDKGIAIKRVTISGIATAQPLHRKKDHLGQPILDHNGQEIPVDFISTGNNHHVAIYEDENGKLQESVVSHFEAVERVNQKLPIIDKTFNQHLGWKFLFTMKQNELFLFPSDDFNPNEIDLFDKQNYTVISKHLFRIQKLSTKDYSFRHHLETNVEEIKDLKTITWRREGLNGIQNIIKVRTNHLGEIIHIGEY

SEQ ID NO: 554 - protein, 1466 aa, Myroides odoratus
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 555 - protein, 241 aa, Neisseria lactamica
MAAFKPNPMNYILGLDIGIASVGWAMVEIDKEENPIRLIDLGVRVFERAEMPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHVSDGLKEGIETLLMA

SEQ ID NO: 556 - protein, 666 aa, Neisseria lactamica
MAAFKPNPMNYILGLDIGIASVGWAMVEVDEEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLVKHRGYLSQRKNEGETADKELGALLKGVADNAHALQTGDFRTPAELALNKFEKESGHIRNQRGDYSHTFSRKDLQAELNLLFEKQKEFGNPHVSDGLKEDIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKNNGFCCKNSMKKDLKNAT

SEQ ID NO: 557 - protein, 828 aa, Neisseria lactamica
MLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYGKKNTEEKIYLPPIPADEIRNPVVLRALSQARKVINAVVRRYDSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTSEKLRTLLAEKLSSRPEAVHEYVTPLFVSRAPNRKMSGQGHMETVKSAKRLDEGISVLRVPLTQLKLKDLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKAELKKETFFGYFSGLDRSTGNISLRSHDLDKTKGKDGVYRIGIKTALSFQKHQIDELGKEIRPCRLKKRPPVR

SEQ ID NO: 558 - protein, 408 aa, Neisseria lactamica
MNDTRYVNRFLCQFVADHILLTGKGKRRVFASNGQITNLLRGFWGLRKVRTENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKTKSTNSAKKSDHAV

SEQ ID NO: 559 - protein, 1082 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 560 - protein, 976 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGIFAG

SEQ ID NO: 561 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 562 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 563 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 564 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 565 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLYQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 566 - protein, 1081 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 567 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 568 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGGKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 569 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEEIYLPPITADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKENSREWQEFKARVETSRFPRSKKQRILLQKFDEDGFKERNLNDTRYVNRFLCQFVADRMRLTGKGKKRVFASNGQITNLLRGFWGLHKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKDLEKMVNRAREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 570 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADKIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 571 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 572 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 573 - protein, 1082 aa, Neisseria meningitidis
MAAFKPNPINYILGLDIGIASVGWAMVEIDEEENPIRLIDLSVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFVWLTKLNNLRILEQGSERPLTDTERATLMDEPYRKSKLTYAQARKLLGLEDTAFFKGLRYGKDNAEASTLMEMKAYHAISRALEKEGLKDKKSPLRLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 574 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 575 - protein, 67 aa, Neisseria meningitidis
MFGYFASCHRGTGNINIRIHDLDHKIGKNGILEGIGVKTALSFQKYQIDELGKEIRPCRLKKRPPVR

SEQ ID NO: 576 - protein, 220 aa, Neisseria mucosa
MRHIFSDGLKEGIETLLMTQRPALSGDAVQKMLGHCTFEPTEPKAAKNTYTAERFIWLTKLNNLRILEQGSERPLTNTERATLMDEPYRKSKLTYAQARKLLGLKDTAFFKGLRYGKDNAEASTLMEMKAYHAISRALEKEGLKDKKSPLNLSPELQDEIGTAFSLFKTDEDITGRLKTELTPASNKTLSRPFTVKSASNGSTSAPWLPSTKWFLHFKPA

SEQ ID NO: 577 - protein, 392 aa, Neisseria sp.
MAPFTLKPLNYILGLDIGIASVGWAVVETDSDVLPYRLIDVGVRTFDRAEVPKTGESPAAARRLARSVRRMIRRRAHRMLRARRLLKREGMLQAADFDAHGLVENLPVNPWQLRVDALSRKLMPLEWAAVLLHMVKHRGYLSQRKNERNSSDKELGALLSGVAANSEALQGGDFRTPAELAVNKFEKESGHIRNQRGDYSHTFNRKDVQAELVLLFEKQKEYGNPYISDGLLTGVEDLLMTQRAALSGDAVQKMLGRCTFEPEEYKAAKNTYSAERFVWLTKLNNLRILDQGSERPLTDSERAKLMDEPYKKTKLTYAQVRRLLELDDTAFFKGLRYSKDNAESATLMEMKAYHSISGALEKAGLKNKKIAAGLIARIAGRNRRGVFAIQNR

SEQ ID NO: 578 - protein, 701 aa, Neisseria sp.
MQDEIGEAFSLFKTDEDIRGRLKGKLPDEQLDALLEYVSFDKFVQLSLKALRKILPLMEQGKRYDEACAEIYGDHYGIKDDKQAQFLPPVSADEIRNPVVLRALSQARKVVNAVVRRYGSPARVHIETAREVGKSFLDRKKIEKRQEENRKDRERSIAKFREYFPNFVGEPKAKDILKMRLYEQQQGQCLYSGKAIDLRRLNEKGYVEIDHALPFSRTWDDSFNNKVLVLAGENQNKRNQTPFEWLGGDEKRWREFTARVEHCRFPRSKKQRILMQKLDEKDFKERNLNDTRYVNRFLCNFIAQNMLLTGEDKNRVFASNGQITNLLRGMWGLKKVRESNDRHHALDAVVVACSTVAMQQKITNYVRQKEMNVFDGEMVDKTTGEVSRLHFPQPWDFFRQEVMMRVFGKPDTPSENNEEADTPEKLRALLADKLSSRPEAVHEAVTPLFVSRAPSRKMSGQGHMETIKSAKRLSEGKSVLRVPLTQLTPKLLENMVNREREPQLYEDLLGRLNAHGGDPAKAFAAPFFKRDKAGNPTQQVKAVRVEDVQKSGVIVREGNGVADNATMVRVDVFEKGGKYYLMPIYTWQAAKGILPNKAVIAHTDEANWQEMDTSFTFKFALYPNDLVLASLKKETYFGYFAGLDRSTGNISLRVHDLEKSKGKDGVYRIGVKTALSFQKYQVDELGKTIRPCRLKKRPPVR

SEQ ID NO: 579 - protein, 1089 aa, Neisseria sp.
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 580 - protein, 1097 aa, Neisseria wadsworthii
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 581 - protein, 1426 aa, Niabella soli
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 582 - protein, 79 aa, Nitritalea halalkaliphila
MPLRLPERVYKMISSTGAECHFLPVNVSSLIKGYDAKSKLGEFGSQNKQEVTSDSFIRVKERCYKLEINRLGIPLNRLK

SEQ ID NO: 583 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 584 - protein, 1389 aa, Oenococcus kitaharae; identical to SEQ ID NO: 241

SEQ ID NO: 585 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 586 - protein, 103 aa, Parabacteroides merdae
MIVYRLFYRFLFKATKLVNFVIHKELKRQIARTGKIKFHSGGCGCQSGNYKMQNFEKGKSITTNADRTLKRSMRRNLYRCKLRRDVLIELLKKVGFIPEKQWK

SEQ ID NO: 587 - protein, 82 aa, Parabacteroides merdae
MSIWKLQYPPLDLKIYNKFLVYSRVNPLTVDEMQNFEKGKSITTNADRTLKRSMRRNLQRYKLRRDVLIELLKKVGFMSEKQ

SEQ ID NO: 588 - protein, 84 aa, Parabacteroides merdae
MSIWKLQYPPLDLKIYNKFLVYSRVNPLTVDEMQNFEKGKSITTNADRTLKRSMRRNLYRCKLRRDVLIELLKKVGFIPEKQWK

SEQ ID NO: 589 - protein, 398 aa, Pasteurella bettyae
MLANENQNKGNLTPYEWLDGKNNSKRWQDFVARVQTCCFSHRKKQHILSHKLDEKSFIERNLNDTRYVARFLCNFIADNMLLTGKGKRKVFASNGQITALLRGRWGLQKVRDDNDRHHALDAVVIACSTVAMQQKITRFVKYEEGNVFSGERIDRETGEIIPLYFPTPWKFFKENVEIRIFSENPKLELENRLPDYPQYNHEFVQPLFVSRMPTRKMTGQGHMETIKSAKRLDEGISVLKVPLTQLKLADLENMVNRERELALYEALKERLELFGNDPAKAFIEPFYKKGGALVKAVRVKKVQKSGVLVRDGNGVADNALMVRVDVFTKGGKYFLVPIYTWQVAKGILPNKAVTANIDEIDWLEMDESYQFIFTMYPNDLVKVKLKKEEFFGYYGGLD

SEQ ID NO: 590 - protein, 610 aa, Pasteurella bettyae
MNMLKPLNYILGLDLGIGSVGWAVVEIDEQGNPLRLIDVGVRTFERAEVAKTGESLALARRLARSSRRLVKRRAARIKKAKRLLKAENILLSVDEILPNDVWQLRVKGLDHKLERQEWAAVLLHLLKRRGYLSQRKNESKSENKELGALLSGVVTNHQILQTDEYRTPAEIAVHKFQAEDGHIRNQRGDYTHTFSRLDLLAEMELLFQRQTELGNLHTSSKLLENLTALLMWQKPALAGEAILKMLGKCTFEPTEYKAAKNSYSAERFVWLTKLNNLRILEQGAERALTDSERFVLLDQPYEKAKLTYAQVRTLLKLSDEAIFKGVRYQGEDKKTVESKTTLMEMKAYHQIRKALDGADLKDEWNTLKNDSALLDEIGTAFSLYKTDDDISHYLGGKLSEKVLNVLLENLNFDKFIQLSLKALQKILPLMLQGQRYDEAVSAVYGDHYGKKSAESCRLLPAIPANEIHNPVVLRTLTQARKVINAVVRLYGSPARIHIETGRKVGKSYQDRKKLEKQQEENREQRESAVKKFKEYFPNFVGEPKGKDILKLRLYELQQSKCLYSGKSFDPNRLLEKGYVEVDHALPFSRTWDDSFNNKVCLPMKTRIKAI

SEQ ID NO: 591 - protein, 199 aa, Pasteurella multocida
MACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNA

SEQ ID NO: 592 - protein, 63 aa, Pasteurella multocida
MQTTNLSYILGLDLGIASVGWAVVEINENEDPIGLIDVGVRIFERAEVPKTGESLALSRRLAR

SEQ ID NO: 593 - protein, 1058 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 594 - protein, 1056 aa, Pasteurella multocida
MQTTNLSYILGLDLGIASVGWAVVEINENEDPIGLIDVGVRIFERAEVPKTGESLALSRRLARSTRRLIRRRARRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVFLNFDKFIELALKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKIRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 595 - protein, 134 aa, Pasteurella multocida
MVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKK

SEQ ID NO: 596 - protein, 53 aa, Pasteurella multocida
YSKENAESATFMELKAWHAIRKALENQGLKDTWQDLAKKPDLLDEIGTAFSLL

SEQ ID NO: 597 - protein, 1366 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 598 - protein, 1229 aa, Pediococcus acidilactici; identical to SEQ ID NO: 130

SEQ ID NO: 599 - protein, 270 aa, Pediococcus lolii
LFNQTIYSAKASKTMIPIKNDRPTKLYGGYSGNEDAYMSIIRLSDKKKTYKVVGISMRDASKLKAYENNAHEEYLKKLKEVIEQQFLDSGKKTKADFEIVIPKVNYHQRMQDGTKQFRIGSSKYVHNTKQLVLSEKTLKAIRNNKQYNGDAEKDLINAFDEILTIVNDSFSIFDIRSFRKKLNESRDKFVSLPVEDTKEKSKVIKGKRETLKQILIALHANGTSQDIPQLGLKSFGKMVKTGGLTLSENTALIHQSPSGLFEHKIKLSDL

SEQ ID NO: 600 - protein, 1016 aa, Pediococcus lolii
MNGIFDAHLAEVDPTFLARLKESNRSNLDPKKSFQGSLLFPERKDYQFYKEYPTIYHLRKALMEKDRKFDIREIYLAVHHIIKYRGNFLNGTPMRSFKVENIELDTLFDRLNQLYEEIIPDNELAFDLEQVADVKEVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHSDAKKAKALKETYTAYVGKTDDKTQNKDDFYKAVEKNLDDSPEAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWHSTENFMQIQTRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIERDKKVVAPETGEILWSNVAPNETIKQIKKVYDYKFMLTSHETYTKHG

SEQ ID NO: 601 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 602 - protein, 211 aa, Porphyromonas catoniae
MGKKVLGLDLGVGSIGWCLITLDKDEKPQSILGMGSRIVPLSADDATEFTQGKAITKNKMRTVARTIRKGMDRYQLRREALKKVLREHAMLPDEALIKLPLLELWELRARAATPGEQVSLTELGRVLLHINQKRGYKHAKADEAAEAETKKGKETGYVAQVKGRYQILKEKGLTIGQHFAGELRANQQTAPRGTYYTYRIKEQVYPRVRGV

SEQ ID NO: 603 - protein, 1009 aa, Porphyromonas catoniae
MRIIREAYIEEYDRIMAVQRVFYPELLTDALIGRIRDRIIFYQRPLKSCKQLVSFCEFEKKEKVIRVKHTNKEGVQELVEKTITIGPKVAPKSSPIFQVCKVWESIHNIRLYHPDGTERKLEQEEKQKLFDYLQRNDKLSLTTLRKELKIKPKDKLWCDKLLEKGIAGNTTAAILRKAFKGYEHYERLFRFDLVRRDSHEADEDGVIRPIIDESYQNEPLYKLWHILYSIEDRAEMRSALIGQLGIKAEDLDNGLMDALYKIDFVKQGYGNKSAKFICKLLPHLQEGKMYSEAAEAAGMRHSDSMTAQERDERNLLEEIPLLQKNALRQPVVEKVLNQMINLVNALKREHGEIDEVRVELARELKMSREEREKATKNNSSREKENKAIAERITEYGLTPTKSRIQKYRLWQESAESCIYCGKRVDVVQFLRGEETEVEHIIPKSILFDDSLSNKACACRSCNQEKGNRFAMEYIQAKGWEQDYIERVDSLFHDKKISYSKRQHLLMLPKDLPEDFIERHLRLSQYISREAQGILRKGIRLVSASEGGVTAKLRQLWGYDNILRDLNLERYKSMGETEVVTVEHRDGQRTDERIKDWSKRKDHRHHAIDALVVACTRQSYIQRLNRVNAEADRQEMDAFIKEQQQEHKLSKKEKLSLLENWLKEQPHFTTGEVKEHAEGILISFRPGKRTVSRGRNIYKRSGKTDVQRNVLIPRGALSEETVYGVISVDGENKVVCKYPLQKFLDTKETNVDKIADQAAEKIVDKVLREKIRERIKRYGKKEAFAEPLYLDEAQTQVVRSVRCFISKDQAKLIPLRYNDESEAVGFVAPGNNHHLALYRDASGKMRASVVSFFAAVERARYGIPMIVLNPRETREKARIIPDLPESIFSKLPEEDWVLEETLQEGEMVLLGMENDAIEEAIKKKDYSKLSRYLYRVQSLSYNDYKFCFHLETESEKKEKKKGEDKKRGEKAKNTAVMPPKRYRIRCLATYQEDLNPRKVKIDLLGRISLA

SEQ ID NO: 604 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 605 - protein, 1422 aa, Prevotella denticola
MTQKVLGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKNFNAWILLDFDGDGKPDYSSPYQLRRELVIRQFDFDQPIERYKLGRALYHIAQHRGFKSSKGETLSQQETNSKQSLTDDTADVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQYAKDKEGKVLMKEGRPQINPTIKFVIRRELKYKKSSTDSGFASWDDLGKAIVDKELFALMKGQFPEGTSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 606 - protein, 443 aa, Prevotella disiens
MELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKESYFGAIEQKGEIKYVMRKELSALKIEDIKNIVDAVVKEKVLAVVKKKGFKQAMAEPIYMNEDKRILIKKVRLFVSQTNPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVVEIEKDGRVKLKFHQEARSEGLNKNSAAFKIQDTPESLYRHTKSNLKVLVNGVDFKINILGEISLI

SEQ ID NO: 607 - protein, 1375 aa, Prevotella histicola
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 608 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 609 - protein, 129 aa, Prevotella multiformis
MQKGGTGCKINRQTVGNVEVNVLNLRLYDRTDDREVTAGYLPTKEDYVRLFVYLNDRKEINQDTLLKDYFRLKKVKCGNEKEFAIRWNYIEDKEKKYPCNETRHELLAALDRAGMEHGWLDDSGTSARW

SEQ ID NO: 610 - protein, 535 aa, Prevotella multiformis
MVKGLLSNIVRTAEEREETSKFVISCTGRITDRLKQDWGLNDVWNSLVYTRFKRLNELTETEAFGHWQDKDRRVFQTSVPLELQRGFSKKRIDHRHHAMDALVIACASRNIIGYLNNESAESPEKREDLRRKLCDKNHIIRKPWESFTQDARAALEDIVVSFKNYVRIINKATNYYERYDADGRKTKAEQKGGEMWAVRKPMHEATYYGKVNLRRKERVSLKAALEDIPSICNRDLRDYINGLVEKHFNKEQVLAQFRSVGNRWNKQHIDKVDVWRFSDGKEEMVATRKPLDTSFDAKRIEAVTDTGIQRILSNYLEAKGGDPKIAFTPEGIADMNQHITAYNNGKQHKPILKVRVSTKLGKKYPVGQTGCKAGQFVVAEAGTNLYFAVYEDGEGNRSYDTIPLNEAVECLKQGLPPVPETREKGDRLKFYLSPNDLVYVPAGDEENEIDRERIYKFVDSSGTTANFIPHRTAGLIYNVDKKLAEALCNGSIIQNEYGVGSQQSKNQKALTGEMVKAVCWKLEVDRLGNILRIIK

SEQ ID NO: 611 - protein, 1380 aa, Prevotella nigrescens
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 612 - protein, 1506 aa, Prevotella nigrescens
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 613 - protein, 774 aa, Prevotella oulorum
MEQCILETLRTVYDIWKEAGQIDEIHVELGREMKQTAEQRAHLTEKVLRNENTNLRIKSLLMELKNDADMKDVRPYSPMQQEILRIYEEGALQTLSKDDAAFTEIMKISKMAQPSASELQRYRLWLEQKYRSPYTGKPISLSKLFTSAYQIEHIIPKKRYFDDSFSNKVICEAEVNGKKDSMLAYEFIKDCGGDVIHCTTLGDVTILSEAEYKALVTELYANNKSKKDKLLMEDIPQDFINRQLNDSRYISRVVMTLLSNIVRIEGEEEATSKFVIPCSGGITDKLKKDWGLNDVWNNIVYPRFERLNALTNTSDFGQWENKEGKRVFQTSVPLELQRGYQKKRIDHRHHAMDALVIACASRKIINYLNNQEANDPTKQENARKQLCIKSRIIRKPWETFTQDAYKALDNIVVSFKNYVRVINKATNYYERYNADGKKAVDEQKGEAMWAIRKPMHKDTVFGHVNLRRKAVVKLKDALENIPAICDKTLRHYIQDLQKKHFNTKQLLAHFKSINYRLNKQAVDKVEVWQYSDDKEQLAATRKPLGPSFDAKCIAAITDTGIQKILLNYLQAKGGDPAIAFTPEGIAEMNQNIAVYNGGKQHQPILKVRIAKPMGKKFPIGQTGNKAFQYVIAEEGTNLYFAIYEDEEGNRTYDTIALREVVERLKQGLTPVPEKNEKGVALKFHLSPNDLVYVPTADELLSKVCSLDKNRIYKMVSATKSECLFIPHSVAKTIYDKVEFEALNKMGRALTGEMIKSVCWKIEVDRLGHIVNIIK

SEQ ID NO: 614 - protein, 691 aa, Prevotella oulorum
MKTILGLDLGTNSIGWAKVIVDDNENYLRDIQLGSRIIPMSQDVLGKFDKGVTESQTAIRTSFRGVRRLRERTLQRRERLHRVLHTLHYLPPHYDSAIGWDRKTPTTYGKFLNHGEPKLAWERREDGTMQFLFMDAFHEMIADFAKYQPALVADGKKVPLDWTIYYLRKKALTQPIKKEELAWILLNFNQKRGYYQLRGEEDEENAAKHEEYHELKVVGVEVDEAGKGDNTWYNVKLENGWTYHRQSKIPLDDWVGKVRAFIVTTEYEKDGTTPKKDKEGNVKRSFRSPDEKDWGLRKKQTEHSLEASGTPVGAFIYDHLLKEPSDKIRGKFIHTIERKYYKQELAAILREQSKHHEKLCSKDMLKACIEELYPNNPLHRESLLKKDMPYLLIEDLIFYQRPLKSKKSLIAECPYEAYSYVDKETGEMKRQGIKCIAKSNPYYQEFRLWQLIANLRLRNRSDERDVTAEYLPHQEDYVRLFTYLNDRKEINQETLLKDFFKLKKVTIGGEKVFPIRWDYIEDKEKKYPCNATRHELLLALDRAGIEHDWLNDRDLAYRLWHLLYSVDSKDETERALRKLKDDDAFVESFLKIKPFEKEYGAYSEKAIKKLLPVMRRGSLWNEADLCPSTKERIANILQGTIDEKLKKKIGAFISSCQQVSDFQGLPEWLACYVVYGRHSEATDIQRWETPE

SEQ ID NO: 615 - protein, 242 aa, Prevotella saccharolytica
MKLVLGLDLGVGSVGWALIFITDSGEPIKILALGERIVSMDSNNSNEFSAGATCTLNQKKTKAKSVRKGYSRYVQRRDALTAELRHIGMMPDETLIKLPVLDLWQLRANAATEGKKLSLAEIGRVLYHINQRRGYKHGKSDVSSDNKQKGYVKAVNERYCMIQERQQTIGQYFALKLKETAVTTEKGTFYTFRIKDQVFPREAYEEEFVVAYSTKVLKFKQITTLLNVVICLMMLLLIVQRY

SEQ ID NO: 616 - protein, 1174 aa, Prevotella sp.
MEFHPELCDAELLKACAEELYRNNEAHRAQLLAKDFKHLLVEDVLFYQRPLKSKKSLIANCPYETRQYINKETGEIKDVNVKCIAKSNPYFQEFRLWQWISNLRLLRQADGQDVTAAYIKGNEDKERLFDLLNNQGEIKQEHILRDFLKLKKPKGGEFPLRWNYVDDKIYPANETRHAINKAIKGMAVDKEEKETLGQLLDQPAVAYMLWNLLYSITDRNELARALRRFALTHGVSSVDAFVESFLKVKPFKKEYGAYSEKATKKLLQVMRLGKYWCGDELPEPAKRTKGNKQAVYDEMAHRGICKQTLQNISNIIEENIDERLMGALLNPERPLTELSHFQGLSVSDACYVVYGRHSEVAEIVKWKDADELNTFINNFKQHSMRNPIVEQCVLETLRTVRDVWEQEGQIDEIHVELGRNMKRTAEQRARDTQAIQRNENTNMRISLLLTELKNDPSISDVRPYSPSQRELLKIYEEGALENLTNQDEDIAKISRLAQPSASELRRYKLWLDQKYVSPYTGRPIPLAKLFTPAYEIEHIIPQSRYFDNSFSNKVICEAEVNKLKDNLLGMEFIKKFGGKTKGILDEEAYKLHVTTNYAHNPAKRSKLLMEDLPTDFNSRQLNDTRYISKTVMALLSNVVREEGERETRSKHVVVCTGGVTDTLKKDWGLHDVWHNLVYPRFIRLNNLTGSQNFGYWRYLNEENSKKGEDSKKVFQITLPPECQRGFVKKRIDHRHHAMDALVIACASANIVNYLNNQSAANPHIHENLQRLLCDRKREIRKPWPTFTQDAQAALKDLVVSFKNTVRVVNKASNTYLRYDKDGKKKRFKQEGEGLKAIRKPMHKETYYGEVNLIRKEMVPLKRALDDVNAIVDKELRASIKGLLRDGFNPQQVLANFKAKDFKFDKRDIKKVEVYVSSEKSTPMVATRKSLDTSFNAKRIADITDTGIQKILLNYLKANDNSPEQAFTPEGIAYLNEHIAEYNDGKPHQPILKVRVSEVKGAKFAVGQTGSKKDKFVEAQSGTNLYFAIYEDKEGKRHFETIALKVAAERLKDKQMPVPEINDAGLPLKFYLSPNDLVYVPTDEDRATAHPSIDKMRIYKMVSATDRQCFFLPFTVASVISNKVEFEALNKMERVLDASEYSSAYDSSHVNKVMVKNVCWKLEVDRLGNITKIVR

SEQ ID NO: 617 - protein, 992 aa, Prevotella sp.
MITRILGLDTGTNSLAWAVVDRDANGNYTLVKRGDVIFTEGVKIEKGIESSKAAERTAHKALRVHYSRRRLHKIDTLKVLVELNLCPCLSDEQLSQWKAKKTYPLTDDFMLWQRSGSAEENNPYYCRHRCLTQKLDLTDQSQRFLLGRAFYHLAQRRGFLSNRLDTSADSDESGKVKSGIAQLSVEMEKAGCEFLGEYFYQLYKQHGNTIKLRSRYTDREEHYKKEFLAICEKQELDPKWVEALQRAIYFQRPLKSQRKGVGKCTFEPKKPRCAESHPDYEAFRMLCFLNNVKIQTPNDTSLRPLNEDEREKIWPIFFRKSKPNFDFEDIAKALAGKNNYAWYKDAGEKPFKFNYRMQQGVSGCPVTAQLIDIFGSDWQTAIAETYTAVEKKNGTKTIDEMADDVWNVLYSFSSKDKLKAFATEKLQLDEASATKFANAKLPHGFASLSLKAIRNILPFLRQGFIYAHAVHLAKIPDIVTKAVWNDADKREMILSGLMEIIENYNPKDRGVEGTIDFCIKSHLQDVIDLRPGAADALYHPSMIETYPDAKLNKMGVFQLGSPRTNAIRNPMAMRSLHILRSVVNQLLRDGIIDRDTEVHVEYARELNDANKRKAIADYQREQEKKRKQYRDDIIALYKSECHKEIEPTDTDILKFQLWEEQNHLCLYTGTQIGICDFLGDNPKFDIEHTVPRSVGGDSTQMNLTLCDATFNRQVKGAQLPSQLSNHADILVRIDHWKSKCEDLRKQLDKIRTYGGMEKNMKDRLIQKRHRLKMDLDYWQGKYSRFTMTEVPEGFSRRQGAGIGLVSKYAGLFLKSLFHNEQNPNKSNVYVVKGVTTAEFRRMWGLQGEYEKKSRLNHCHHCIDAITIACIGKAEYDKMAQYYHDEELFQWRGTTTKPHFNKPWPTFTEDVLAIEQSLLVKHLTKDNMPKQAKKRVRTATGKYLAQGDTARGSLHKDTYYGAIEQNGEIRYVLRKPLNKFENEAELEKIVDQA

SEQ ID NO: 618 - protein, 1375 aa, Prevotella sp.
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 619 - protein, 1483 aa, Prevotella sp.
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 620 - protein, 593 aa, Prevotella sp.
MNTRILGLDTGTNSLAWAVVDRDAKGNYTLVRRGDVIFTEGVNVDGQPVPSKAAVKSKYKSLRVQYARRRLRKIDTLKVLVSLDLCPYLSDQQLSQWKAKKTYPLTDDFMLWQRSGSAEENNPYYCRYRCLTQKLDLTDQSQRFLLGRAFYHLAQRRGFLSNRLDTTSDSAESGKVKSGIAQLSVEMEKAGCTFLGEYFYQLYKQHGNTVRLRSRYTDREEHYIKEFLAICEKQELDAQWVEKLQRALYFQRPLKSQRKGVGKCTFEPKKPRCAESHPDYEAFRMLCILNNIKIKTPKDVSLRPLNAEEREKVWPLFFRKSKPNFDFEDIAKALAGKNNYAWYKDAGEKPFRFNYRMHQGVSGCPVTAQLIDIFGSDWKAGIAETYTAVGKKNGTKTIDEMADDVWNVLYSFSSKDKLKAFATDKLQLDEARATKFANAKLPHGFAALSLKAIRNILPFLRQGFIYAHAVLLAKIPDIVTAAVWDDADKREQILSGLLEVIENYNPDDRGIEGTIDFCIKSHLQDVVDLRPGAADALYHPSMIEAYPDAKLNKMGVFQLGSPRTNAIRNPMAMRSLHILRSVVNLLLRDGMLS

SEQ ID NO: 621 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 622 - protein, 241 aa, Prevotella sp.
QAVKEKIKEAIAGKNFKTAIAEPIFMNKEKGIRINKVRYYVKAQERLKIRQQRDLSSKEYKQFFCVENESNYLLAIYEGELKGKKERDFCVVNNLDSAACLKRSNKGKAAPLVPERSEERNLPLLAVLKRGTQVLFYENSPEEILFDNPQDLVRRLYKVTGINTKKDVKNGKTYLYGNIELRFHQNAQKKDDVKMQSGVYKNNEVLRQGIVLSHKQFKALVEGVDFEFNVLGEIKKKERHA

SEQ ID NO: 623 - protein, 1216 aa, Prevotella stercorea
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 624 - protein, 1487 aa, Prevotella timonensis; identical to SEQ ID NO: 135

SEQ ID NO: 625 - protein, 770 aa, Pseudoramibacter alactolyticus
MAKGYFASDEEIDFSGVDDGFKNTLSSHQKFKEIFDVEVLNDWQKSMSEKIIFWATVYGDSKKFLKERLEDAYGNELDQKQIKRILGLRFKDWGRLSEAFLNLEGKNSKTNQSQTIIEALWNGDGTNNFNLMELLSSQFTYRDTLKKRALKGEKTLTNITYEDLSDLYLSPSVRRMVWQTILIVKELRQVLGAGPAKIFIEMARDVTLKAGTRTTSRRQQLLDLYKNVQTESRNWVEEIETQEESRFRSKKIFLYYTQMGQCMYTGEPIVFKDLFNRNLYDIDHIYPRHFVKDDSLINNLVLVKKQANSHKSDTFPIENSIQQARRDFWKWLSEKGLISREKFNRLTRRTSFSDEELAGFISRQIVETRQGTKAVAQIFENALPDSEVVYVKAGNVSDFRHHFNLLKCREINDLHHAQDAYLNVVVGNVYHTKFTKNPINFIKGYRKDRKAYAYHMDQIFDHPVKRNDIIAWQTDKNQSIATVKKVMAKGTPLVTRMSYEEHGELSNQNICSAKAAQKAEGKGYLPIKNSERLSNTQRYGGYNKYAGSYFFLVEHTLKKNRVRTIETMPLFLRDTIKTSKDLLKYCCESLKLEAPSIRVMKIKMGSLLSVNGAFVYLTGRSGKKLITPNGFQLILPQKWQDYIRLLIKTKDSPDDVEGISGGKNIEFYDILVEKHTKTCLKNRPNPIGEKLREWRNDFIALDNQKQSDILLEILKLTTFDNSGADLRAIGGKNQSGVSTIGKKISSQKSVVLVHRSVTGIFEKQVDLLSI

SEQ ID NO: 626 - protein, 103 aa, Rhizobium etli
MSGEQLTREIGRSGVKASAVGLGTWAIGGWMWGGTDEAQSIAAIQASLDAGVTLIDTAPAYGLGRSEEIVGKALAGRRDKAVIATKCGLVWHTQKGNHFFDQD

SEQ ID NO: 627 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 628 - protein, 1405 aa, Riemerella anatipestifer
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 629 - protein, 1145 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKCHYLKMVNL

SEQ ID NO: 630 - protein, 1400 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 631 - protein, 1128 aa, Roseburia intestinalis
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 632 - protein, 1471 aa, Scardovia wiggsiae
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 633 - protein, 116 aa, Sphingobacterium spiritivorum
MFRKYFEEKNSARLLFTLKQGDFVYVPDDNEEVILDESSPLFIDYWKNISERSNNIHVVQKFSGKEIYFLKHTIADTIAKKIEFGSQDCYQSLNGKSIKEFCIKIDSDRLGNISKV

SEQ ID NO: 634 - protein, 1306 aa, Sphingobacterium spiritivorum; identical to SEQ ID NO: 98

SEQ ID NO: 635 - protein, 1110 aa, Sphingobium sp.
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 636 - protein, 1084 aa, Sporolactobacillus vineae
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 637 - protein, 475 aa, Staphylococcus massiliensis
MGQDYILGLDIGITSVGYGLIDYHDKSVIDAGVRLFKEANVENNEGRRSKRGSRRLQRRRKHRLARTRNLLESYQLNPFPKCEKNPYEIRVKGFKEVLTSDELSAALLHLAKRRGIDNVHVTDTESDSSDNGLSTKEQLAKNQKALESRYVCELQLERLLNDNKVRGANNRFKTQDFVREAKQILSIQKDHHNLDQVFIDKYISLLETRREYYEGPGKGSPYGWDGDIKKWYELLMGRCTYFPESLRSVKYAYSADLFNALNDLNNLVIVRDENDKLTYPEKYHIVENVFKQRKKPTLKQIAKEIDVAPEDIRGYRVTASGTPVFTSFKLYHDIKSVTSNDKVLEDTELLDAIAEVLTIYQSPIEVQEKLESLNVILTKEEIEGISKLTGYTGTHALSLKAIQIVIDELWETNDNQMTIFTRLNMKPQKVDLAKANKIPTSLVEDFIISPVAKRAFIQSIKVINAVIKNMVCLKI

SEQ ID NO: 638 - protein, 581 aa, Staphylococcus massiliensis
MPKDIIIELAREKNSDEERKIIRDVQKRNQQTRDLVDKVIKETGKTKAKGMVEKLILHDKQEGKCLYSLKSIPLEDLLNNPHHYEVDHIIPRSVSYDNSMNNKVLVLQEENSKKSNQTPFQYFNSSNTHITFKQFKQHVLNLSKTKDRITKKKKEYLLEERDINKFSVQKEFINRNLVDTRYATRELMTLLRAYFSANELDVKVKAINGGFTSYLRKRWDFKKDRNAGYKHHAEDALIIANVDFIFKQLKALDNAKKVMEGRKVQVEKDNVEDNEHYESLFREPDQIKEIKLYDNYKFSHRVDKKPNRELINDTIYSTRKVDNKTYTIQTVNNIYDKQNDQLKKLFNKSPEKFLMYKHDPKTFDKLATIMRQYKNEKNPLYKFHDETGEYLTKYAKKDNGPIVKSLKYIGKQVNAHLDITNDYENSNNKVVKLSLKPFRFDVYLDDGKYKFVTVKYLDIIKKDTYYVIDEEKYKLALQQKKISENAKFIGSFYNNDLIKINGELLRVIGVNDDAKNTLELNMIDISYRDYVENMNLATTPRIRKNIGKSITILEKYTTDILGNTFKISSPEKPQFIFKVRD

SEQ ID NO: 639 - protein, 1334 aa, Staphylococcus pseudintermedius; identical to SEQ ID NO: 205

SEQ ID NO: 640 - protein, 1112 aa, Staphylococcus simulans; identical to SEQ ID NO: 252

SEQ ID NO: 641 - protein, 773 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQ

SEQ ID NO: 642 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 643 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 644 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 645 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 646 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 647 - protein, 1370 aa, Streptococcus agalactiae
  VARIANT 117: note = X can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 648 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 649 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 650 - protein, 1370 aa, Streptococcus agalactiae
  VARIANT 9: note = X can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 651 - protein, 1125 aa, Streptococcus anginosus
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 652 - protein, 1386 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 653 - protein, 1396 aa, Streptococcus anginosus
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 654 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 655 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 656 - protein, 538 aa, Streptococcus dysgalactiae
DYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIRLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 657 - protein, 1155 aa, Streptococcus dysgalactiae
MDKKYSIGLDIGTNSVGWAVITDDYKVPSKKFKVLGNTDRHSIKKNLIGALLFDSGETAEATRLKRSARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNRRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKYQSYKMEK

SEQ ID NO: 658 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 659 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 660 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 661 - protein, 1370 aa, Streptococcus gallolyticus; identical to SEQ ID NO: 209

SEQ ID NO: 662 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 663 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 664 - protein, 1392 aa, Streptococcus mitis
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 665 - protein, 1134 aa, Streptococcus mutans
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNMRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIVKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKSYVKGLKTLSNKKKDYLLTEENIDKIEVKQKFIERNLVDTRYSSRVVLNALQDFYKERKFDTKISVVRGQFTSQLRRKWRIEKTRETYHHHAVDALIIAASSQLNLWKKQNNPLISYKEDQFVDPETGEILSLSDDEYKKLVFKAPYEHFVDTLKSKKFEDSILFSYQVDSKYNRKISGATICGTRKAQLGKDTQEETYVLGKIKDIYSQKGYEDFIKKYKKDKTQFLMYHKDPQTFEKVIEEILKTYPDKELNEKGKEVSCNPFEKYRQENGPVRKYSKKGNGPEIKSLKYYDEVLGKNIDITPKNSLNKVVLRSLNPWRTDVYFNHETRKYEFLGLKYSDLRYLKGEHRYGILIGDYKKIKDKEGIEKESEFKFTLYKNDLILIKDTAKGKEELFRFWSRTGKDNAKTFEKNKIELKPYSKSQFEKGEDTNVLGKLYASSNQLQKSFGTLENLSIYKVRTDVLGNKYFIKKEGDKPQLNFKKKL

SEQ ID NO: 666 - protein, 1134 aa, Streptococcus mutans; identical to SEQ ID NO: 665

SEQ ID NO: 667 - protein, 1128 aa, Streptococcus mutans
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 668 - protein, 1128 aa, Streptococcus mutans; identical to SEQ ID NO: 667

SEQ ID NO: 669 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 670 - protein, 1338 aa, Streptococcus mutans; identical to SEQ ID NO: 669

SEQ ID NO: 671 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 672 - protein, 1345 aa, Streptococcus mutans; identical to SEQ ID NO: 671

SEQ ID NO: 673 - protein, 1229 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNIQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHY

SEQ ID NO: 674 - protein, 1229 aa, Streptococcus mutans; identical to SEQ ID NO: 673

SEQ ID NO: 675 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 676 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYSFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRIRKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 677 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 678 - protein, 1345 aa, Streptococcus mutans; identical to SEQ ID NO: 675

SEQ ID NO: 679 - protein, 1350 aa, Streptococcus mutans; identical to SEQ ID NO: 676

SEQ ID NO: 680 - protein, 1350 aa, Streptococcus mutans; identical to SEQ ID NO: 677

SEQ ID NO: 681 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 682 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 683 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 684 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 685 - protein, 1345 aa, Streptococcus mutans; identical to SEQ ID NO: 681

SEQ ID NO: 686 - protein, 1345 aa, Streptococcus mutans; identical to SEQ ID NO: 682

SEQ ID NO: 687 - protein, 1345 aa, Streptococcus mutans; identical to SEQ ID NO: 683

SEQ ID NO: 688 - protein, 1345 aa, Streptococcus mutans; identical to SEQ ID NO: 684

SEQ ID NO: 689 - protein, 1345 aa, Streptococcus mutans; identical to SEQ ID NO: 682

SEQ ID NO: 690 - protein, 1345 aa, Streptococcus mutans; identical to SEQ ID NO: 682

SEQ ID NO: 691 - protein, 1345 aa, Streptococcus mutans; identical to SEQ ID NO: 682

SEQ ID NO: 692 - protein, 1345 aa, Streptococcus mutans; identical to SEQ ID NO: 682

SEQ ID NO: 693 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 694 - protein, 1359 aa, Streptococcus mutans; identical to SEQ ID NO: 693

SEQ ID NO: 695 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 696 - protein, 1355 aa, Streptococcus mutans; identical to SEQ ID NO: 695

SEQ ID NO: 697 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 698 - protein, 1345 aa, Streptococcus mutans; identical to SEQ ID NO: 697

SEQ ID NO: 699 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 700 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 701 - protein, 1345 aa, Streptococcus mutans; identical to SEQ ID NO: 700

SEQ ID NO: 702 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 703 - protein, 1345 aa, Streptococcus mutans; identical to SEQ ID NO: 702

SEQ ID NO: 704 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 705 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 706 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 707 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 708 - protein, 1345 aa, Streptococcus mutans; identical to SEQ ID NO: 707

SEQ ID NO: 709 - protein, 1345 aa, Streptococcus mutans; identical to SEQ ID NO: 704

SEQ ID NO: 710 - protein, 1345 aa, Streptococcus mutans; identical to SEQ ID NO: 705

SEQ ID NO: 711 - protein, 1345 aa, Streptococcus mutans; identical to SEQ ID NO: 706

SEQ ID NO: 712 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 713 - protein, 1345 aa, Streptococcus mutans; identical to SEQ ID NO: 712

SEQ ID NO: 714 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 715 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 716 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 717 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 718 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 719 - protein, 1345 aa, Streptococcus mutans; identical to SEQ ID NO: 718

SEQ ID NO: 720 - protein, 1345 aa, Streptococcus mutans; identical to SEQ ID NO: 714

SEQ ID NO: 721 - protein, 1345 aa, Streptococcus mutans; identical to SEQ ID NO: 715

SEQ ID NO: 722 - protein, 1345 aa, Streptococcus mutans; identical to SEQ ID NO: 716

SEQ ID NO: 723 - protein, 1345 aa, Streptococcus mutans; identical to SEQ ID NO: 717

SEQ ID NO: 724 - protein, 1345 aa, Streptococcus mutans; identical to SEQ ID NO: 716

SEQ ID NO: 725 - protein, 1345 aa, Streptococcus mutans; identical to SEQ ID NO: 716

SEQ ID NO: 726 - protein, 1345 aa, Streptococcus mutans; identical to SEQ ID NO: 716

SEQ ID NO: 727 - protein, 1345 aa, Streptococcus mutans; identical to SEQ ID NO: 717

SEQ ID NO: 728 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 729 - protein, 1345 aa, Streptococcus mutans; identical to SEQ ID NO: 728

SEQ ID NO: 730 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 731 - protein, 1345 aa, Streptococcus mutans; identical to SEQ ID NO: 730

SEQ ID NO: 732 - protein, 1350 aa, Streptococcus mutans
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 733 - protein, 1350 aa, Streptococcus mutans; identical to SEQ ID NO: 732

SEQ ID NO: 734 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 735 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 736 - protein, 1345 aa, Streptococcus mutans; identical to SEQ ID NO: 735

SEQ ID NO: 737 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 738 - protein, 1345 aa, Streptococcus mutans; identical to SEQ ID NO: 737

SEQ ID NO: 739 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 740 - protein, 1355 aa, Streptococcus mutans; identical to SEQ ID NO: 739

SEQ ID NO: 741 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLEAAKLLKEIAKLVGCQVEEIKGYRLDNKDKPDLHTFEPFRKLKSNLTTIAVENLSITTLDTLAHILTLNTEREGIEEAIQKELPNIFSDEQITGIIAVRKKNSQIFGKGWHSFSIKLMKELIPELYETSEEQMTILIRLKKVKTNSKITNRTKYINEQEVTDEIYNPVVSKSIRQTVKIINAAIKKYGAFDQIVIEMPRESNEEDERKFIADLQKSNAKEKDDAMKQAALLYNGKAELPHGVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 742 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLGAAKLLKEIAKLVGCQVEEIKGYRLDNKDKPDLHTFEPFRKLKSNLTTIAVENLSITTLDTLAHILTLNTEREGIEEAIQKELPNIFSDEQITEIIAVRKKNSQIFGKGWHSFSIKLMKELIPELYETSEEQMTILTRLKKVKTNSKITNRTKYINEEEITDEIYNPVVSKSIRQTVKIINATIKKYGAFDQIIIEMPRESNEEDERKFIADLQKSNAKEKDDAMKQAALLYNGKDELPHDVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 743 - protein, 1125 aa, Streptococcus mutans; identical to SEQ ID NO: 742

SEQ ID NO: 744 - protein, 1125 aa, Streptococcus mutans; identical to SEQ ID NO: 741

SEQ ID NO: 745 - protein, 670 aa, Streptococcus oralis
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIGKIDKNFYRRLDESFRVLGDKSEDIQIKQPFFGNKELETAYHKKYPTIYHLRKHLADADKNSPVADIREVYMALSHIFKYRGHFLTLGKIDPNNINMQNSWIDFIESCQDAFDLEISDESKTIAAIFKSSDNRQEKVKGILSYFQPELAKKDKSIFKQLLQLLFGLKTKFKECFELEEEPDLNFSKENYDENLENLLGTLEEDFPDVFAKLKILRDTILLSDMLTYTGATHARFSATMVERYEEHRKDLQRFKSFVKQNLSEQDYLDIFGRKTPNGFDVDKETKGYVGYISNKMVLTNKQKTIQQNFYDYISGKITGIEGAEYFLNKISDGTFLRKLRTTDNGTIPNQIHAYELEKIIERQGRDYPFLLENKDKLLSILTFKIPYYVGPLAKGNNSRFAWIKRTTSQDVLDNNDEDTKNGKIRPWNYHKLINMDETRDAFITNLIGNDIILLNEKVLPKRSLIYEEVMLQNELTRIKYKDKYGKIHFFDSELRQEIINNLFKTNSKRVSSAMLLAYLENFTNLQAVEIVSGIEKGKSLNSTLKTYNDLKTIFSEDLLDSEIYQKELEEIIKVITVFV

SEQ ID NO: 746 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 747 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 748 - protein, 1121 aa, Streptococcus oralis
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 749 - protein, 1134 aa, Streptococcus oralis
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 750 - protein, 550 aa, Streptococcus oralis
MYSLDKNGSPTPLYRDQLNQYEVDHIIPYSFLPIDSIDNKVLTHRENNQRKLDNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATIRKYLYSNIMRFFNNPDSKVSKDIWDCNRDLPIIKDIIYNSQVNFVKRTMIKKGAFYNQNPVGKFNKQIAANNRYPLKTKVSSLDTSIYGGYGPMNSALSIIIIAERFNEKKCKIETVKEFHDIFIIDYKKFNNDPFQFLNDTSENGFLKKNNINRVLAFYRVPKYSLMQKIDGTRMLFESKSNLHKATQFKLTKTQNELFFHMRRLLTKSNLMDLKSESAIKESQNFILKHKEEFDNISNQLSAFSQKMLGDTTSLKNLIKGYNERKIKEINSSEETIKYFYDNFIKMFSFVKSGAPKDINDFFNNKYTVARMRPKPDKKLLNATLIHQSITGLYETRIDLSKLGED

SEQ ID NO: 751 - protein, 1140 aa, Streptococcus parasanguinis
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 752 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 753 - protein, 1052 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 754 - protein, 1368 aa, Streptococcus pyogenes; identical to SEQ ID NO: 42

SEQ ID NO: 755 - protein, 1367 aa, Streptococcus pyogenes; identical to SEQ ID NO: 246

SEQ ID NO: 756 - protein, 1368 aa, Streptococcus pyogenes [sequence omitted]

SEQ ID NO: 757 - protein, 1370 aa, Streptococcus ratti
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 758 - protein, 1135 aa, Streptococcus salivarius
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 759 - protein, 1127 aa, Streptococcus salivarius
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 760 - protein, 1385 aa, Streptococcus salivarius
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 761 - protein, 1392 aa, Streptococcus sanguinis
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 762 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 763 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 764 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 765 - protein, 317 aa, Streptococcus sp.
FEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 766 - protein, 1420 aa, Streptococcus sp.
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 767 - protein, 1371 aa, Streptococcus sp.
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 768 - protein, 93 aa, Streptococcus sp.
MILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 769 - protein, 1121 aa, Streptococcus sp.
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 770 - protein, 1026 aa, Streptococcus sp.
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYK

SEQ ID NO: 771 - protein, 1377 aa, Streptococcus sp.
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 772 - protein, 1371 aa, Streptococcus sp.
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 773 - protein, 1139 aa, Streptococcus sp.
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 774 - protein, 1375 aa, Streptococcus sp.
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 775 - protein, 206 aa, Streptococcus sp.
RTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATR

SEQ ID NO: 776 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 777 - protein, 1381 aa, Streptococcus suis
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 778 - protein, 39 aa, Streptococcus thermophilus
GRCIKGLGKSNISIYKVRTDVLGNQHIIKNEGDKPKLDF

SEQ ID NO: 779 - protein, 302 aa, Streptococcus thermophilus
MIRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAERFILSKPIEK

SEQ ID NO: 780 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADIYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 781 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 782 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 783 - protein, 1122 aa, Streptococcus thermophilus
MSDLVLGLDIGIGSVGVGILNKVTGEIIHKNSRIFPAAQAENNVERRTNRQGRRLTRRKKHRRVRLNRLFEESGLITDFTKISINLNPYQLRVRGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKASSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKLSDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRADVYFNKTTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 784 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVCEINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 785 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 786 - protein, 595 aa, Streptococcus thermophilus
MVQFRKANSSIFGKGWHNFSVKLMMELIPELYETSEEQMTILKRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQFLDIETGELISDDEYKESVFKAPYQHFVDTLKSKEFEDSILFSYQVDSKFNRKISDATIYATRKAKLDKEKKEYTYTLGKIKDIYTQAGYDAFIKIYKKDKSKFLMYHHDPQTFEKVIEPILENYPNKEINEKGKEVPCNPFLKYKEEHGYIRKYSKKGNGPEIKSFKYYDNLLGRHIDITPKNSKNIVALRKLNPWRTDVYFNHETMKYEFLGLKYADISYKKSKNKAGDFLPK

SEQ ID NO: 787 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 788 - protein, 1038 aa, Streptococcus vestibularis
MIDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSEEQKNQIINYVKNEKAMGPAKLFKYIAKLLSCDIADIKGYRIDKSDKAEIHTFEAYRKMKTLETIDIEKMSREELDKLAYVLTLNTEREGIQEALEHEFVDGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARATNEDDEKKAIQKIQKANKDEKDAAMLKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKNKSQFLMYQKDRKTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQVFRFWSRTGKDNPKRFEKHKIELKPYEKARFEKGEELEVLGKVPPSSNQLQKNMQIENLSIFKVRTDVLGNQHIIKNEGDKPKLDF

SEQ ID NO: 789 - protein, 97 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKIDR

SEQ ID NO: 790 - protein, 1084 aa, Subdoligranulum sp.
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 791 - protein, 951 aa, Sutterella parvirubra
MPTVRPVFHSSASFDLGAKNTGLFLVNHPAGAAPSAEYAAAYTIVQPADGDGLNYSTTNRRAVRHRLRGGKRFKLARRLVLQVIDALRKLKPGLIRDEEMRRTVEALSSLLKRRGFTRIESEAQVDPTTLDSVDPAVFADHETLGGFFSLGIPISTQWDALSQNPGAVEQLFKALPSAKDFGKYVTEQFPEFAEQKKLYADAIKVLSSEAKSIVMQLGLGHHHRSKYFEMIAHDMLRDPRLQGVFELFGSEERFKTFICNVSNLQLRALRWYFDEPNPEVANQWNPEKFQVVWLRGLKYFHPDAERKADMKKLIDELTASKDILDALCTTDPRRTIPPYEDQNNRRPPFDQTLWLSAAELTRRYGDKWRIWSQKFERADRALSTGLDEILLYTDRRSRMFNRNQDPSVYADSYVLQRVLDRSSKLDRYALRALAAGYRTQELHEPLATLSDTLGTQHVETFLTFAAEYYEEVAAAKNGLWLDGPSRLLERADIHPPMKKKVLDLLLGNILDATPEIGRILRTVLWNRHVHEKSRSTPASLCRSIEAIRKDFGGEFRMRYDALDAKIRAAEDQKKKFKPTNAEEKDLFKAWNATKTMHAFLRDVLQLTPKQLERTASPYVFAQLHTLIDTERDGFTSTSLAAHLENHWRMRANAAGMAQCSRLPADAVRPFDGVLSKALDRQAFEAAKLAAQHLMSRKELTDTDIRYSIIIESNRFAFSASTAELKKNTLAKKNAEKGLNFELKRWQDKDSRIREASRGICAYTGAKLGDVVEYDHIIPRAFTTSAMGSVFNSEANLICVSRPGNQTKADKRYGLNKLHKTYLTAVFGTADVTTIAASIEDIVGKLASANRLRHFELLNEKEQDAVRHALFLDDESDARRIVLRELAAQNKSRVNGTQAWFVRAFMTKLLEITKDWRERTGNTLDIRSWKTDAEVASRLRSALNFHAEITLT

SEQ ID NO: 792 - protein, 406 aa, Sutterella parvirubra
SNLFREEVPYGDHFLPIIQMKNRIYIGYQLPKADGTGGNAVAVLGKDPLELLETLKPFLDREPQAFSDHPVTYKMINERAYELLTKCALTPDQTTELERTQAEVLRSLNYQTSRAAVLGRLVDDKNKFVAKDAVWKEKDFVISFKLSPKKSAFKASGQLELPAKSDWKALVDSPELAINWGQPADDTFSQRIERKVRMNSSHLEHTPKKRVVSLPVVDKPSGGFRIRRHNLDGSAVFQVHTVANNKYGGFSADSAGKVDWSTPVLCGHLQHANLVPLDPETASAEQLVRMSEWRVVETTSDIRLEVCPGTSGRRYVRVELPFTLLQEWLTAGKVADVPVSPLHLPGSIKLTDPKTFCAEAQKTLSIFAQPRATIFFEQLGDRVRFRFEASGGPATMNAAYNAAGRS

SEQ ID NO: 793 - protein, 389 aa, Sutterella wadsworthensis
MKACDLEEKTNHLQACVAIDLGARYTGTFSILHKSSHLPSKDDCRAATYVLPEDGGKMTYSQRNRTAVRHRIRGKKRFALARRMAMLIIREKLAAKSVTLTSSETRRLAEAVGSLLRRRGYNRLETETDNDLTVLENIEPEVFSEHEILGKYFYAGTDLAIQWETLSQDLSKISSLLAERLSEKDFKKYLTGLIPDDKNKIKHIISVFKMLIDEAESINMQCVLGHKHRTQYLSDIHADMHRDTRLSKAAEAFGGVDRLWRLLGNLSNLQLRAHRWYFNAPHLFDDQALEPARLQKTLVRAFKYLHCPQGVESRAQAELVKELEEADDIIDALCTIDPVRTIPPYENQQNRRPPFDQTLYLSPDLGVSGFLCLGRLFQGQPNEAALCFL

SEQ ID NO: 794 - protein, 976 aa, Tannerella sp.
MKKILGLDLGSNSIGWALVNEAENRDEASSIIKLGVRVNPLTVDEMQNFEKGKSITTNADRTLKRSMRRNLQRYKLRRDALIKLLKKVGFITDGTILSEQGNRTTFETYRLRAKAPDEEISLQELARVLLMINKKRGYKSSRKIKEKEAGTLIDGMEVAKKLYDEDLTPGQLCLQLLESGKKSLPDFYSSDLQEEFDRIWNFQKQFNPKAFCDTAKEEIKGKNKSQTWAILAKYFIWMEEMDVWNEKESKTERVEKECKLVGLKRTVKKEEQRKENYCWRVQALTEQLDLEKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKPTDKIIEQLQVIFADLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVVEKILNQMVNVINAIIDTYGKPDEIRVELARELKKSAKEREELTKAIAKSTREHEEIRKVLQEEFGMINVSRNDIIRYKLYKELKDNGYKTLYSNQDIPKEKVFSKEIDIEHIIPQARLFDDSLSNKTLEYKAINIEKGNKTAYDFVKEKYGEKGLQQYLNRCESLFKGHRTKLRKLKMGQENIPEGFIDRDLRNTQYIAKKALAMLNEICRRVVATTGSITDRLREDWQLVDVLKELRCFRYFKDTKMKANHNKNIFYTSIKVDVSDTSKILK

SEQ ID NO: 795 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 796 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 797 - protein, 769 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKCCGRL

SEQ ID NO: 798 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 799 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 800 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 801 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 802 - protein, 357 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQAFFEYLREDMEVDIDADSQKIKEILKDSSLKNSEKQSRLNKILGLKSSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKITTITPDM

SEQ ID NO: 803 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 804 - protein, 631 aa, Treponema denticola
MLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLRSEIQSKQRGFWNFLQRNNFISLEKLNRLTRTTPISDDETAKFIARQLVETRQATKVAAKVLEKMFPETKIVYSKAETVSMFRNKFDIVKCREINDFHHAHDAYLNIVVGNIYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKENKIRSLETIPLYLVKDIQKSQEKLKSYLTDLLGKKEIKILVPKIKINSLLKINGFPCHITGKTNDSFLLRPAVQFCCSNDEVLYFKKIIRFNEIRSQREKMGKTISPYEDLSFRSYIKENLCKKTKNDEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 805 - protein, 631 aa, Treponema denticola
MLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 806 - protein, 370 aa, Treponema denticola
MTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEDIIRWAAIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKCCGRL

SEQ ID NO: 807 - protein, 591 aa, Treponema phagedenis
MARGKEAEKGRTSSRYASIKALYENCKQDLADYDAVLEQFKSEEPLRLRSDKLYLYYTQLGRCMYTGRVIDIDRLMSDNSAYDIDHIYPRSKIKDDSLTNRVLVVKDANQDKRDEPLSPQIQDKQKGFWDFLKHNNFISIEKYERLTYRGYFTEEMLSGFIARQLVETRQGTKTAGQILEQLYPDSTVVYCKAANTSEFRQKFNLIKCREINDLHHAHDAYLNIAVGNVYYTKFTSNPRNFMKLKEPYNLRELFDRDVERNNTIAWVKNKTITTIKDMLKRNTPLYTRYAYCKTGGFFDQNIMKKGKGQFPLKENSPLSDISKYGGYNKVSGAYFILVQKKEKDAVVRILETVPLYLLNKPGKESENVREYLSTALGTKDFKILIPKIKINSLFKINGFLVHITGKTNDRFLVRSAVQFFCDDNLTLFFKRIIAFNGLRNLNKDKSMTAYDDNTMRVYVRGNLFKDKNQLFDKNKFNEIVKGKNISVYKDMVKRYETSIYKFRPNTAVIPILKSGEDKFINLPIEEQFKILQEILKLFGAINGTANLTLIGGRPSTGEMKISNNISNLKQCILIHQSPTGVFEQQIDLLKI

SEQ ID NO: 808 - protein, 1062 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEKIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 809 - protein, 281 aa, Treponema vincentii
MKTLGLDIGTNSIGWGIVDETANKIEDCGVYIFPEGVKKEKGNESSKAAERTSFRLARRLKFRRKLRKCETLKVLIKNKMCPLTMEELEKWRKQKIYPVSQDFLNWYRTDELKNWEPYFLRKKCAEQKAGPYEIGRALYHLAQRRGFLSNRKESTKASDGKVSKSIDELSSLMDGRTLGQYFYELKQSGEKVRGKYTSRKEHYEKEFNKICEVQEISPELKDDLYRAIFFQRKLKSQKFLVGKCTFERNKPRAPISHFEFEEFRMLSFINSIKIAKKLRRR

SEQ ID NO: 810 - protein, 675 aa, unidentified
  source 1..675: note = uncultured bacterium
MTAENYSNVRFAFDIGTNSIGWAVFQLNDKQEATSILNAGARIFSDGRDPKTFEPLAVRRRNVRSASRMRDRYLRRRKRTLDKLIGYGLLPEDKAERDKILLETNDKPSGSTDKKTDPYSLRARALEEKLPLAYVARALFHIGQRRGFKSNRKADRKSNEKGKIAAGIEELSGLMHQSHAPTLGAYLAKRREEGHVVRLRASSEALTNKAYAFYPERAMLEDEFHKIWQAQAEYYPDVLTKEREEELFHVMFFQRPLKEQKVGLCTLVEGELRLPKSDPLFQQFRLYKEINELAIILPDLSQRKLTMEERDTLITLMRPAKTKTFAALRKALKIPAGGRFNKETENRKQLTGDEVYSVFSKPELFGGDWAKFSIEQQREIIDQLNNEENPDKLEEWLKNKFPKLSDEQRSEIINANLPDGYGRFGITATSKILEQLKKDVISEAEAAHRCGFDHSLANRNWKGLDELPRYQEVLERHIVPGTGDKNDIYDIYKGRLTNPTVHIGLNQVRRLTNRLIKAYGKPWQIVVELARDLPMSSEERKEHNKTLNDNIKAGFERTQKLERLGQKDNANNRLLLKLWEELGKDPDDRKSIYSGTRITEPMLFSGEVEIDHILPFSLTYDDSYANKILCLREENRIKRNRAPADVTEWKDRYDEIIGRSKNCQRTNKNVLGPMQ

SEQ ID NO: 811 - protein, 1017 aa, unidentified
  source 1..1017: note = uncultured bacterium
MRVDSLGRCLSDEEWARVIYHLCKHRGFHWISRAEAKQTEGDSKSEGGKVKQGLAGTAKLMDEKGYRSAAEMVLAEFPEAQRNKQGEYRKALSRELLAKELALLFARQRVFGNRHATDTLETAILGNSDKKSGLFWQQKPALAGADLLKMLGTCTFEKNEYRAPKASFTAERHVWLTRLNNLRIVTDGITRQLTEQERQLVLPLPYRQAGDLTYKQLGMALTKAGLLEAGCFKFIGLAYPTEAQKAEGKTKDPESATLVKIPAWQELRQTLNKASLNDEWEKLSGDALCGQPEIFDKIAWILSVYKDDDEVRTELAKLVLPNPEGLTEALLNIRFDKFHALSLKALRAIVPHMEKGLRYDEACVQAGYHHSQLHKIGEGEHKYLPPLYDGRDGDGRMIFAEDADIPRNPVVLRSLNQARKVVNAIIRRYGSPSAVHIEMARDLSRPFDERNKIKKDQDEYQARNQRDREQFIELFGHPPKGLEFEKWRLYREQNGQCAYSQKPLASSGDVAEIFLDGSTEIDHALPYSRSFDDSKNNKVLVLTRENRDKGNRTPYEYLGGAENSERWQRFFSFVESNKAYRLAKRTRLLRKDFGAKESEEFRERNLNDTRYVCRFFKNYVEQHLKLAEGSEAKRCVVVSGQLTNFLRTRWGLLKIRSDSDRHHALDAAVVAACSHSMVQRLSNYSRTRELEQVRDGFVNIETGEIVNPAMHQQLREHFPDPWPYFRHELEARLKIDSPALLREEMARLSSYTEEELAALKPLFVSRAPQRRNGGAAHKDTIYGQPEKLKKNGSVSQKVALASLALKDIDLLADPHRNAKLYGAIRERLEAHGGKGDKAFPATNPLRKPDKEGNPTGPIVRTVTKVIDKLSGIPVRGGIAKNDTMLRVDVFTKAGRFHLVPVYVHHRVTGLPNQAITRGKDENQWAIIDDTFEWRFSLYPNDLVQIRLKDETHLGYYASTDRSTSSISIWAHDRNQSVGKDGLIRSIGVTTAKDIEKFHVDTLGNVYPAPPEKRRGLA

SEQ ID NO: 812 - protein, 600 aa, unidentified
  source 1..600: note = uncultured bacterium
VNAIIKKHGSLSAVHIEMARDLSRPLDERREVKKLQEEFKDRNDKARESFEADHGYRPKGIVFEKWMLYREQHGKCAYSMEGLDIDRVLNDANYAQIDHALPYSRSYDDSKNNKVLVLTRENQNKGNRTAYEYLTSFAGGEDGDRWRNYAAWVNSNKSYRMAKRNRLLRKNYGPDEASGFKDRNLNDTRYICKFFKNYVEEHLQLAPRADGNANKRCVVVNGQLTAFLRARWGLSKVRSESDRHHALDAAVVAACSHGMVKALADYARNKEVAYLREGFPDPETGEIINPEAHARGVHHFPEPWAHFRHELQVRLYSDDLQALREDLQRLGTYSEQDLLGVRTLFVSRAPQRRNDGAVHKETIYAQPEALRKQGGVVQKVPLTSLSLKDLDNLADPHRNAKLYTALRARLEAHGGKADKAFGPDQPFYKPDKNGNPTGPIVRTIKLVIDKLSGIPIRGGVAKNDTMLRVDVFTKAGKFHLVPVYVHHRVTGLPDRAIVAFKDEVEWTQVDDSFKFLFSIHPNDLIRIGLKAKEPMIGYFASCHRGTGAFNVWSHDRNTSVGKSGSVEGIGIKTALSLEKLNIDVLGNVYPARPEQRHGLA

SEQ ID NO: 813 - protein, 1011 aa, unidentified
  source 1..1011: note = uncultured delta
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 814 - protein, 1011 aa, unidentified; identical to SEQ ID NO: 813
  source 1..1011: note = uncultured delta proteobacterium HF0070_07E19

SEQ ID NO: 815 - protein, 1120 aa, Veillonella sp.
MGFKANLVNLFTDEDIEVILPEEKEFKSINLHEGIYEDVRDAYEDAWGDRFAIVDQCKVLHDIIVISSIIKPGQSLSEAKIESYNQHKEDLVLLKSVLKEDRKLYDDMFVVDTDKGTNYVKYTKQGVNGNTSATQEEFYKYVRKVVSVLPETEHTRRIVQKLEEGTFLPLQRISKNGVVPYQLHKEELVRILDKATVNFPFLNKVENGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDHAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGEKEKTAFEMLEDLSLSPMVKRSVWQTLRILDEIVSIRKELPKKIFVEVARTNKADKKRTQSRKALLEELYKQIKDEDVHVLQQELESKEDSALNSKKLYLYFTQMGRCMYSGRRIDIHELFTDKYDIDHIYPRSLTKDDSWHNIVLVEKQLNAEKTDRFPILSAIQSKQKGFWKLLWDRGFISEKKYDRLVRTTDLTDEELNQFINRQMVSTNQSVKAVTTLLHQLYPETEVVFSKAENVSDFRHDYDFVKVRSINHHHHAKDAYLNIVVGNVYHEKFTKNFLSFAKQKGTRRTYNLTKIFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSIDSAVDVVMDITSSVYIKLLEKVAIKKIENPKTFRIENIKTSYNHKEVTVSKEQNIALYQELLKKLDTPLFSKMKGNKLEEFRTVGFDTFIALSLEEQASVLLEVLNVLTNFKTKRDITKIGMTSSRSTLGINISNTEQFSVITTSITGLYEQEIKIK

SEQ ID NO: 816 - protein, 983 aa, Verminephrobacter aporrectodeae
MRRRRDRLLKRKARMHDQLMRHGFFPADAAGRKVLERLNPYQLRAKGLHQALTPGEFARALFHINQRRGFQSNRKTDRKDNESGALKQAISELRAQIHDSGCATVGEWFWKERMQQKPEGVHRQGVRARYRETPYTTDEGRQRIDKRYDLYVDRAMIEQEFDALWAVQAALQPGLFTDAACKELRYTLLFQRKLRPVKPGRCTLLPEEERAPLALPSTQRFRILQEVNHLRLLDEALREVPLTLAQRDALVAALESQGKLGFAPMRKLLKLPGTVKFNLEDEKRTELKGNATSAILARKDLFGPAWAGFDAALQDEIVWQLVSEEGEGRLIAWLQQHTGVDEARAEAIADTSLPEGYGSLSRKALERIVPALQREVCSYDKAVQAAGFAHHSDLGFDFEHSGDEVQQVGERIIASTGEVRPLFAFKQLPYYGKALQRHVAFGSGKPEDPEEKRHGKIANPTVHIGLNQVRTVVNALIRRYGRPSEVVVELARDLKQSREQQQETQRKQAENQRRNTRIRERIAETLGISPERVRSSDIQKWILWEELSFDVVDRRCPYSGEQISTTMLLSPKVEIEHILPFSQTLDDSLNNRTVALREANRIKRNRTPWDARADFEARGWSYEGILHRAERMPLRKRYRFAPDGYQRWLGEDKDFLARALNDTRYLSRVAANYLRLVCPKPQGVRVIPGRMTAMLRAKFGLNDVLGLDGEKNRNDHRHHAVDACVIGVTDQGLMQRFARASAQAREDGLTRLVQDMPLPWPSYRDHVERAVRHIWVSHKPDHGFEGAMMEETAYGIRKDGSIKPRRKADGSAGREVVNLIRITESRQPVRHGVDSQGQPLPYKGYVGGSNYCIEITANDQGKWEGAVISTFEAYRIVRASGWGRLRHCSHGQNGRPLMMRLMIGDAVRLALDGSEKTMRVVKISANGQVFLVAPNEANVDARNRDKADPFAYVSKKAGSFQSAKARQVSISPIGELRDPGFKG

SEQ ID NO: 817 - protein, 4 aa, synthetic construct
  REGION 1..4: note = Synthetic Sequence
AAAA

SEQ ID NO: 818 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 819 - protein, 1307 aa, unidentified
  REGION 1..1307: note = Synthetic Sequence
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 820 - protein, 1246 aa, unidentified
  REGION 1..1246: note = Synthetic Sequence
MLKNVGIDRLDVEKGRKNMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 821 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 822 - protein, 1326 aa, Prevotella disiens
MKVMENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 823 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 824 - protein, 872 aa, Alicyclobacillus contaminans
MGFNTAELLRKVEEEMRKTSVGFDTDNPFAHRITRRAIRGWDRIAEAWRRLPPDAPESEYIEAFKDIQRKNPRKIGSEPLFKNLAAPGVRSELLNNPQVLITFAKYNELQRQLAKAKQFAQKTLPHPVFHPVWVRYDKLGGNLHHYQIEPAVHANDTHKVKFSSLLLPQEDGSYAEVKDVTVSLAPSLQFPTGLVHPKVTTPPRTGLVTVMDEEAGKPVVCYRDRGHDALVPVAFGGAKLQFNRAHLSAGYRKGVLSAGGGGSIYFNVTLDVQVPNERDVSKTFSFSRDRDLVSLKAEELKRYMETKPLGMPGVRVMSVDLGVRYGAAISVFEVKPFAEVRKDKLHYPITGCEGFVAEHERSVILKLPGEGVRTAGKQSERKQALAAIRAEMSILRKWLRVSQVTEEDRAKAVRGLLEDERGGGWTMDPGEDSDHQPLQQFLHEARLAVGELVNLVHLSPAEWERAVIERHRRLERITASHIRVFQTMRKVWGKRRNEDAAHTGGISLAHIEHLIQQRKLFIRWSTHARTYGEVRRLPKHEGFAKRLQKHTNHVKEDRIKKLADMIVMAARGYRFLDKRARWVKTRHAPCDLILFEDLSRYRFTMDRPPTENSQLMNWSHRELLKTVKMQAALFGIGVGTVPAAFTSRFDAQTGAPGLRCKRVTKQDKEKTPFWLIQFAEITGVNVTNVEPGQLIPVDGGEWFVSPKGPRAADGLKCVHADINAAHNLQRRFWIPRLPSVKCRRYVEAEGFAAVPSSTAFMKVHGKGAFVSVDGEFYEYQKGRRVAVNRADRTSSTLDEDEGDIGEEMLVSSNGAGEFVRMFYDESGYVGYGRWMDSKVFWGKVRQIVHRAIQDQVEKRAAARGENGATSSR

SEQ ID NO: 825 - protein, 1149 aa, Desulfovibrio inopinatus
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 826 - protein, 1194 aa, Desulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 827 - protein, 1132 aa, Tuberibacillus calidus
MATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 828 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 829 - protein, 1108 aa, unidentified
  REGION 1..1108: note = Synthetic Sequence
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 830 - protein, 658 aa, Methylobacterium nodulans
MLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 831 - protein, 1302 aa, unidentified
  REGION 1..1302: note = Synthetic Sequence
MKKFELKQNFRNNYSGKTLRNFRQTLAQIANKKSSDSILTIKFKLDCSKTGKLPKYENLISLYDTIEDIKKGTLSYYLFTLIVSGFKFFGSASQAKAFSTKDIFKDNDFYNQFKIQSHLDLPDFVPSKIYQRLKKNVRSTNGKDNAFKASVIVAEYRKEIGKLKNKDESSEHQCEELFKKIGTALETRFSSWQDLINNCSTGCEIIDEILNDSFGTLPSIKKMVLASTTQSSDGEQDGIAIAYDPDSTFIKSDELLNPYFAVATILKSMPPEIQQDKKSAYVKANLTTPTHNALSWIFGKGLTLFQTESTEKLCAMFNVSDKRVIEQVQDAAKAVKLPAELDLNHCTLKFQDFRSSLGGHLDSWTTNYLKRLDELNDLLLNLPKNLSLPDIFMIDGKDFIEYSGCNRDEIQQMIDFVVNEQNRIKLQESLNALLGKGNNQICSDDISTVKDFSEIVNSLHSFVQQIDNSLEQSSNEANSIFSELKKKIEKNEKWDIWKNNLKKIPKLNKLSGGVPDAWKEIREIEQKFHEISENQKKHFTEVMEWIDAGNGTIDIFESRFKYDELLKKSKKNNLQSADELAFRSVLNKLGRFARQGNDLVCEKIKNWFKEQNIFDSSKDFNRYFINQKGFIFKHPSSKKDNSPYNLSANLLEKRYEVTNTVGALLEQCESDPAIVNDPFSMRSLVEFRALWFSINISGISKEQHIPTKIAQPKLDDSTYQESVSPTLKYRLEKEQITSSELNSIFTVYKSLLSGLSIRLSRNSFYLRTKFSWIGNNSLIYCPKETTWKIPAAYFKSDLWNEYKDKQILIVNEEYDVDVVKTFESVYKIVKSKDNNEKNRILPLLKQLPHDWMFKLPFGASNAEKCKVLKLEKNNKKFKPLSVSKDSLARLSGPSTYFNQIDEIMMNDESELSEMTLLADEPVRQQMSNGKIEIIPDDYVMSLAIPITRSLKKGNTESFPFKNIVSIDQGEAGFAYAVFKLSDCGNERAEPIATGLIPIPSIRRLIHSVKKYRGKKQRIQNFNQKFDSTMFTLRENVTGDICGLIVALMKKYNAFPILEKQVGNLESGSKQLMLVYKAVNSKFLAAKVDMQNDQRRSWWYQGNSWNTPILRISNPNQSNNKNIVKNINGKKYEELKIYPGYSVSAYMTSCICHVCGRNALELLKNDDSTGKVKKYQINQDGEVTIGGEVIKLYRKPDRLTPVKNLAKKGNRERTYASINERAPTVSVQKAELSADELQKIIKKNMRRAPRSLMSKDTTQSRYFCVFKNCPCHNKEQHADVNAAINIGRRFLKDCILDDNKEKD

SEQ ID NO: 832 - protein, 1255 aa, unidentified
  REGION 1..1255: note = Synthetic Sequence
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGSVLHRYTFSGVDAHKAKRREYWYNGELWEHPYLMAKKWNEETNSMSGAPKPVSLFPGVTVNAARTSQICHQCQRNPMSHLRGLTGTIEISSDGLLELDDGTIRLFETSDYDEDKFKQSRREKRRLDANVLLSGRHRAEYIYTVAKRNLRRPPKNVMTKDTTQSRYTCLYKNCSWTGHADENAAINIGRRYLAERIDMPASKTKAAV

SEQ ID NO: 833 - protein, 1266 aa, unidentified
  REGION 1..1266: note = Synthetic Sequence
MRPRFHGGMNARDWRKHVGVLAQQHKETTRTYTFPLDTTGSAIDFDAALQAYNAVEGVGYGSLLGLACAVHLSGFRLFSTGKEAATFRNRARYPNAAFQAALRKELGTTITTLTPETLDRLFSSRPKRRNGVPLPWNQDSIRDRLYTNWVKPRPGDTPDAVLFQIATGIAQEITEDVSSWTDLAKNSDRGLKAAHRYFARVGGFPAFDNLTPPATVQPTDTTIDYDPNAPFHLVSHADQTLIHQSISLCAHRIRQEDPALDPNKSGFIKQLQNNFLSQTFYGLSWLFGAGYVHFRECTANDLAIQYGIPNNCRDGIHQIKSFADAILPNTFFEKKHYRKDSRSVGKKAKSWISNYWQRLLQLQTWVDDHTWVTLPQELTEAQFKPLFRGLLVDAVELMAIAERLPQRLADCRDSLDCLMGKGPQAATKNDVEIVEKVREEIESFVGQIEQLGNQLRHQLENENNDQVHRDNLHQLKNRLPLDLRRPQALNKISGGVPDVAKSIRGLETQLDQVLKERRSHFGRLTKWAKECGITLDPLQPLIESEKQRVAERGSAHDAKELAIRLLLQRIGRLGHRLSPTNATAIQELLRPVFAVKREFNLFFHNHMGALYRSPYSTSRHQPFQINVDVAHGTDWIGTIETLIQNLFTQIQDDALLRDLVQLEGFVFSHKLRALPGVIPSELARPNNLQQMGLPALLLVLLQADQVHRETVLRVFNLYGSAINGYLFQALRPGFIVRAGFQRLETKKLRYVPKAQSWQYPDRLHHAKSAIKNSLSAGWIKKNHQGAILPQKTLTALVKQKSLKDTGVPEYLVQAPHDWYVPIDLRGPAIPIEGLTVGTEGPELTQLGPMKDDCAFRAIGPSSFKSKIDAGLLPQDVKYGDMTLIFDQHYQQSISFANGTFSIQYQPTSLQVKAAIPVVDKRPRDTRNNSHLYDRIVAIDLGERKIGYAIFDLKQVLKSEQLEPMREDGKPLIGSISIRSIRGLMKAVQTHRNRRQPNYRIDQTYSKALMHYRESVIGDVCNAIDTLCARYGGFPVLESSVRNFEVGSAQLKTVYGSVSRRYTWSAVDAHKNQRQQYWLGGTKDKIPIWTHPYLMTREWDEKNSKWSNRSKPLKMHPGVEVHPAGTSQICHQCKRNPIGALWNVADTVVLDDQGQLDLDDGTIRLNSGYIDTTEIKRARRKKIRLPENKPLTGSHKTSHVRAVARRNLRQPPKSTRAKDTTQSRYTCLYVDCGHECHADENAAINIGRKYLQERIHIEASRQALSTR

SEQ ID NO: 834 - protein, 1269 aa, unidentified
  REGION 1..1269: note = Synthetic Sequence
MVAGLKKIKRDGVTMKSNYHGGVKARAWRKRIGGLARRQKETVFTYKFPLETEEAGIDFDKAVQTYGIAEGISQGSLIGLVCAFHLSGFRLFSKADETKAFCNQGRYPNQAFAEKLRNELSVTLPKLSPQSLDVLFQSSPKSKNGVAPEWSKNAIRNRLYTNWTGKGAGTNPDEHLLEIAEDIAAEIDSDLDGWKDLEEHPEKGLSAADRYFQAQGDFPSLTGLPPSVPLTPQNSTVAFEGDPVCLNPSDNTLLHQAVARCAGRILQEQPNLSPDKNRFINQLQDELVSSQNNGLSWLFGVGFKYWKEMSVDQLADDYKVKSTDLDALKQVKSFIDAIPLNPLFDTPHYGEFRASVAGKMRSWVKNYWKRLLDLKSQLGTANINLPEGLDEQRAENLFSGLLIDSKGLRQVTDKLPSRLKKAEDTIDRLMGDGNPTSDDIEQVETVAAEISAFIGQVEQFNNQLEQRLENPLEGDDETFLKQLKIDLPAEFKKPPAINRISGGSPDPTAEIAELEEKLDRLMSARKEHYETIAEWASANKVTLDPMEAMTTLEAQRLTERGAEGDQEEFALRLLLQRIGRLANRLSPQGATAIRDLLRPVFTEKREFNLFFHNRMGSLYRSPYSTSRHQPFTIDVAVAKNTDWMDALDGIAETIMKGLSQAGDELSLRLRDWINISGFSLSQRLRGLPDTVPGELALVRSADDVRIPPMLALQLEEDEVSREVCLKAFNLYVSAINGCLFRALREGFIVRTKFQRLERDVLSYVPKTKLWNYPQRLDTARGPIHSALAAAWINKEGSVIDPVETVTALSDTGFSDDGIPEYLVQAPHDWYTPIDLRDISKPVSGLPVKKNITGLKRQKKQTAFRMVGPSSFKSHLDSTLLSEEVKLGDFTLIFDQYYKQRVSYNGRVKITFEPDRLHVEAAVPVIDKRVRPSTEEDALFDHLLAIDLGEKRVGYAVYDIKACLRTGDIKPLEDGDGKPIVGSVAVPSIRRLMKAVRSHRQQRQPNQKVNQTYSTALMNYRENVIGDVCNRIDTLMEKYNAFPVLESSVMNFEAGSRQLEMVYGSVLHRYTYSKIDAHTAKRKEYWYTGEYWDHPYLMAHKWNERTRSYSGSLSALTLYPGVMVHPAGTSQRCHQCKRNPMVEIKQLTGQVEINADGSLELDDGTICLYEGYDYSPEEYKKAKREKRRLDPNVPLSGRHQAKHVSAVAKRNLRRPTVSMMSGDTTQARYVCLYTDCDFTGHADENAAINIGWKYLTERIALSESKDKAGV

SEQ ID NO: 835 - protein, 1340 aa, unidentified
  REGION 1..1340: note = Synthetic Sequence
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 836 - protein, 1437 aa, unidentified
  REGION 1..1437: note = Synthetic Sequence
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 837 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 838 - protein, 1334 aa, unidentified
  REGION 1..1334: note = Synthetic Sequence
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 839 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 840 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 841 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 842 - protein, 1051 aa, Listeria newyorkensis
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 843 - protein, 1182 aa, Leptotrichia wadei
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 844 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 845 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 846 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 847 - RNA, 86 nt, synthetic construct
  misc_feature 1..86: note = Synthetic Sequence
  source 1..86: mol_type = other RNA
ggaaccattcaaaacagcatagcaagttaaaataaggctagtccgttatcaacttgaaaaagtggcaccgagtcggtgcttttttt

SEQ ID NO: 848 - RNA, 67 nt, synthetic construct
  misc_feature 1..67: note = Synthetic Sequence
  source 1..67: mol_type = other RNA
tagcaagttaaaataaggctagtccgttatcaacttgaaaaagtggcaccgagtcggtgcttttttt

SEQ ID NO: 849 - RNA, 88 nt, Streptococcus pyogenes
  source 1..88: mol_type = transcribed RNA
gttggaaccattcaaaacagcatagcaagttaaaataaggctagtccgttatcaacttgaaaaagtggcaccgagtcggtgctttttt

SEQ ID NO: 850 - RNA, 93 nt, Listeria innocua
  source 1..93: mol_type = transcribed RNA
atattgttagtattcaaaataacatagcaagttaaaataaggctttgtccgttatcaacttttaattaagtagcgctgtttcggcgctttttt

SEQ ID NO: 851 - RNA, 104 nt, Streptococcus mutans
  source 1..104: mol_type = transcribed RNA
tgttggaatcattcgaaacaacacagcaagttaaaataaggcagtgatttttaatccagtccgtacacaacttgaaaaagtgcgcaccgattcggtgctttttt

SEQ ID NO: 852 - RNA, 95 nt, Streptococcus thermophilus
  source 1..95: mol_type = transcribed RNA
ttgtggtttgaaaccattcgaaacaacacagcgagttaaaataaggcttagtccgtactcaacttgaaaaggtggcaccgattcggtgttttttt

SEQ ID NO: 853 - RNA, 118 nt, Streptococcus thermophilus
  source 1..118: mol_type = transcribed RNA
taataatagtgtaagggacgccttacacagttacttaaatcttgcagaagctacaaagataaggcttcatgccgaaatcaacaccctgtcattttatggcagggtgttttcgttattt

SEQ ID NO: 854 - RNA, 112 nt, Neisseria meningitidis
  source 1..112: mol_type = transcribed RNA
catattgtcgcactgcgaaatgagaaccgttgctacaataaggccgtctgaaaagatgtgccgcaacgctctgccccttaaagcttctgctttaaggggcatcgtttatttc

SEQ ID NO: 855 - RNA, 110 nt, Pasteurella multocida
  source 1..110: mol_type = transcribed RNA
gcatattgttgcactgcgaaatgagagacgttgctacaataaggcttctgaaaagaatgaccgtaacgctctgccccttgtgattcttaattgcaaggggcatcgttttt

SEQ ID NO: 856 - RNA, 115 nt, Mycoplasma mobile
  source 1..115: mol_type = transcribed RNA
tattatgtatttcgaaatacagatgtacagttaagaatacataagaatgatacatcactaaaaaaaggctttatgccgtaactactacttattttcaaaataagtagtttttttt

SEQ ID NO: 857 - RNA, 26 nt, synthetic construct
  misc_feature 1..26: note = Synthetic Sequence
  source 1..26: mol_type = other RNA
tagcaagttaaaataaggctagtccg

SEQ ID NO: 858 - RNA, 36 nt, Streptococcus pyogenes
  source 1..36: mol_type = transcribed RNA
ttgttggaaccattcaaaacagcatagcaagttaaa

SEQ ID NO: 859 - RNA, 36 nt, Streptococcus mutans
  source 1..36: mol_type = transcribed RNA
gtgttggaatcattcgaaacaacacagcaagttaaa

SEQ ID NO: 860 - RNA, 36 nt, Streptococcus thermophilus
  source 1..36: mol_type = transcribed RNA
ggtttgaaaccattcgaaacaacacagcgagttaaa

SEQ ID NO: 861 - RNA, 36 nt, Streptococcus thermophilus
  source 1..36: mol_type = transcribed RNA
cttacacagttacttaaatcttgcagaagctacaaa

SEQ ID NO: 862 - RNA, 36 nt, Listeria innocua
  source 1..36: mol_type = transcribed RNA
atattgttagtattcaaaataacatagcaagttaaa

SEQ ID NO: 863 - RNA, 34 nt, Listeria innocua
  source 1..34: mol_type = transcribed RNA
attgttagtattcaaaataacatagcaagttaaa

SEQ ID NO: 864 - RNA, 36 nt, Treponema denticola
  source 1..36: mol_type = transcribed RNA
atttaagatccatcttaaattacacaacgagttcaa

SEQ ID NO: 865 - RNA, 36 nt, Neisseria meningitidis
  source 1..36: mol_type = transcribed RNA
attgtcgcactgcgaaatgagaaccgttgctacaat

SEQ ID NO: 866 - RNA, 38 nt, Neisseria meningitidis
  source 1..38: mol_type = transcribed RNA
atattgtcgcactgcgaaatgagaaccgttgctacaat

SEQ ID NO: 867 - RNA, 36 nt, Streptococcus gordonii; identical to SEQ ID NO: 861
  source 1..36: mol_type = transcribed RNA

SEQ ID NO: 868 - RNA, 36 nt, Bifidobacterium bifidum
  source 1..36: mol_type = transcribed RNA
atgatcaaggtcattgacctgacaggcataaattga

SEQ ID NO: 869 - RNA, 36 nt, Lactobacillus salivarius
  source 1..36: mol_type = transcribed RNA
ggttttgacctcattgatttaacattctgagttgaa

SEQ ID NO: 870 - RNA, 37 nt, Francisella tularensis
  source 1..37: mol_type = transcribed RNA
gtttcagttgttagattatttggtatgtacttgtgtt

SEQ ID NO: 871 - RNA, 37 nt, Francisella tularensis
  source 1..37: mol_type = transcribed RNA
attacagagcattaattatttggtacatttataattt

SEQ ID NO: 872 - RNA, 37 nt, Legionella pneumophila
  source 1..37: mol_type = transcribed RNA
atttcagggtatcgaaatttagatgatttctaattta

SEQ ID NO: 873 - RNA, 36 nt, Nitratifractor salsuginis
  source 1..36: mol_type = transcribed RNA
tgtaacagggtagggttttttgaggggtcttaaaat

SEQ ID NO: 874 - RNA, 36 nt, Butyrivibrio fibrisolvens
  source 1..36: mol_type = transcribed RNA
agtttctaatcacttaattttttcggacctactaaa

SEQ ID NO: 875 - RNA, 36 nt, Streptobacillus moniliformis
  source 1..36: mol_type = transcribed RNA
gattcacattattcaagtttactacagattctgtat

SEQ ID NO: 876 - RNA, 36 nt, Mycoplasma mobile
  source 1..36: mol_type = transcribed RNA
agttaagaatacataagaatgatacatcactaaaaa

SEQ ID NO: 877 - RNA, 44 nt, Capnocytophaga ochracea
  source 1..44: mol_type = transcribed RNA
attgtgaattgctttcaaattgtgcgacaaaagtaggtataata

SEQ ID NO: 878 - RNA, 36 nt, Acidovorax ebreus
  source 1..36: mol_type = transcribed RNA
attgcagcaacggctctcaccccggataaccacaat

SEQ ID NO: 879 - RNA, 36 nt, Wolinella succinogenes
  source 1..36: mol_type = transcribed RNA
atagccgctgcctactcagccatttagcgcagcgac

SEQ ID NO: 880 - RNA, 37 nt, Wolinella succinogenes
  source 1..37: mol_type = transcribed RNA
tttgttaaagctggatgggattattatagagtgttgc

SEQ ID NO: 881 - RNA, 37 nt, Wolinella succinogenes
  source 1..37: mol_type = transcribed RNA
tttcaaggcatcgaacggatttgctataaagtgttgc

SEQ ID NO: 882 - RNA, 36 nt, Prevotella ruminicola
  source 1..36: mol_type = transcribed RNA
ttttgcacacgtaagattcctacatcttatcacaat

SEQ ID NO: 883 - RNA, 48 nt, Fibrobacter succinogenes
  source 1..48: mol_type = transcribed RNA
attgtgaattgctttcagattatgaaaataatatagttaaaatttttg

SEQ ID NO: 884 - RNA, 36 nt, Campylobacter jejuni
  source 1..36: mol_type = transcribed RNA
attttatttcgattttaatcaaccctaaatttcaat

SEQ ID NO: 885 - RNA, 36 nt, Campylobacter jejuni
  source 1..36: mol_type = transcribed RNA
attttagtccctttttaaatttcttatgagattata

SEQ ID NO: 886 - RNA, 25 nt, Campylobacter jejuni
  source 1..25: mol_type = transcribed RNA
aagaaatttaaaaagggactaaaat

SEQ ID NO: 887 - RNA, 36 nt, Pasteurella multocida
  source 1..36: mol_type = transcribed RNA
attgtagcaacgtctctcatttcgcagtgcaacaat

SEQ ID NO: 888 - RNA, 36 nt, Rhodopseudomonas palustris
  source 1..36: mol_type = transcribed RNA
gccgtggctttcctaccgatttcccaccgcatgatt

SEQ ID NO: 889 - RNA, 36 nt, Olsenella uli
  source 1..36: mol_type = transcribed RNA
tctgaattaccagtcagaacgatactgcgagtcaaa

SEQ ID NO: 890 - RNA, 36 nt, Rhodospirillum rubrum
  source 1..36: mol_type = transcribed RNA
gttccatggccccgtcccacacgccatgatagagcg

SEQ ID NO: 891 - RNA, 36 nt, Rhodospirillum rubrum
  source 1..36: mol_type = transcribed RNA
aaacgggagaaccgtcccacacggccatggtagagt

SEQ ID NO: 892 - RNA, 36 nt, Dinoroseobacter shibae
  source 1..36: mol_type = transcribed RNA
ttaacggctcgaccgcgaattctgaacgtaaagaca

SEQ ID NO: 893 - RNA, 36 nt, Verminephrobacter eiseniae
  source 1..36: mol_type = transcribed RNA
ttagcgtccagagcgcatatcccagtgagatatccg

SEQ ID NO: 894 - RNA, 75 nt, Streptococcus pyogenes
  source 1..75: mol_type = transcribed RNA
aaacagcatagcaagttaaaataaggctagtccgttatcaacttgaaaaagtggcaccgagtcggtgcttttttt

SEQ ID NO: 895 - RNA, 77 nt, Listeria innocua
  source 1..77: mol_type = transcribed RNA
aaataacatagcaagttaaaataaggctttgtccgttatcaacttttaattaagtagcgctgtttcggcgctttttt

SEQ ID NO: 896 - RNA, 73 nt, synthetic construct
  misc_feature 1..73: note = Synthetic Sequence
  source 1..73: mol_type = other RNA
aacagcatagcaagttaaaataaggctagtccgttatcaacttgaaaaagtggcaccgagtcggtgctttttt

SEQ ID NO: 897 - RNA, 33 nt, Francisella tularensis
  source 1..33: mol_type = transcribed RNA; sub_species = Francisella novicida
tataaatgtaccaaataattaatgctctgtaat

SEQ ID NO: 898 - RNA, 74 nt, Campylobacter jejuni
  source 1..74: mol_type = transcribed RNA
aagaaatttaaaaagggactaaaataaagagtttgcgggactctgcggggttacaatcccctaaaaccgctttt

SEQ ID NO: 899 - RNA, 96 nt, Francisella tularensis
  source 1..96: mol_type = transcribed RNA; sub_species = Francisella novicida
atctaaaattataaatgtaccaaataattaatgctctgtaatcatttaaaagtattttgaacggacctctgtttgacacgtctgaataactaaaaa

SEQ ID NO: 900 - RNA, 109 nt, Streptococcus thermophilus
  source 1..109: mol_type = transcribed RNA
tgtaagggacgccttacacagttacttaaatcttgcagaagctacaaagataaggcttcatgccgaaatcaacaccctgtcattttatggcagggtgttttcgttattt

SEQ ID NO: 901 - RNA, 110 nt, Mycoplasma mobile
  source 1..110: mol_type = transcribed RNA
tgtatttcgaaatacagatgtacagttaagaatacataagaatgatacatcactaaaaaaaggctttatgccgtaactactacttattttcaaaataagtagtttttttt

SEQ ID NO: 902 - RNA, 92 nt, Listeria innocua
  source 1..92: mol_type = transcribed RNA
attgttagtattcaaaataacatagcaagttaaaataaggctttgtccgttatcaacttttaattaagtagcgctgtttcggcgcttttttt

SEQ ID NO: 903 - RNA, 89 nt, Streptococcus pyogenes
  source 1..89: mol_type = transcribed RNA
gttggaaccattcaaaacagcatagcaagttaaaataaggctagtccgttatcaacttgaaaaagtggcaccgagtcggtgcttttttt

SEQ ID NO: 904 - RNA, 107 nt, Streptococcus mutans
  source 1..107: mol_type = transcribed RNA
gttggaatcattcgaaacaacacagcaagttaaaataaggcagtgatttttaatccagtccgtacacaacttgaaaaagtgcgcaccgattcggtgcttttttattt

SEQ ID NO: 905 - RNA, 96 nt, Streptococcus thermophilus
  source 1..96: mol_type = transcribed RNA
ttgtggtttgaaaccattcgaaacaacacagcgagttaaaataaggcttagtccgtactcaacttgaaaaggtggcaccgattcggtgtttttttt

SEQ ID NO: 906 - RNA, 102 nt, Neisseria meningitidis
  source 1..102: mol_type = transcribed RNA
acatattgtcgcactgcgaaatgagaaccgttgctacaataaggccgtctgaaaagatgtgccgcaacgctctgccccttaaagcttctgctttaaggggca

SEQ ID NO: 907 - RNA, 110 nt, Pasteurella multocida; identical to SEQ ID NO: 855
  source 1..110: mol_type = transcribed RNA

SEQ ID NO: 908 - RNA, 37 nt, Francisella tularensis
  source 1..37: mol_type = transcribed RNA; sub_species = Francisella novicida
aacacaagtacataccaaataatctaacaactgaaac

SEQ ID NO: 909 - RNA, 37 nt, Francisella tularensis
  source 1..37: mol_type = transcribed RNA; sub_species = Francisella novicida
aaattataaatgtaccaaataattaatgctctgtaat

SEQ ID NO: 910 - RNA, 37 nt, Wolinella succinogenes; identical to SEQ ID NO: 881
  source 1..37: mol_type = transcribed RNA

SEQ ID NO: 911 - RNA, 37 nt, Wolinella succinogenes; identical to SEQ ID NO: 880
  source 1..37: mol_type = transcribed RNA

SEQ ID NO: 912 - RNA, 37 nt, unidentified
  source 1..37: mol_type = transcribed RNA; note = gamma proteobacterium
atttcagtgtatagaatgttgggatgcattctgaata

SEQ ID NO: 913 - RNA, 37 nt, unidentified
  source 1..37: mol_type = transcribed RNA; note = gamma proteobacterium
ataacaagggagtatttgctggaataagctctgaaac

SEQ ID NO: 914 - RNA, 37 nt, Sutterella wadsworthensis
  source 1..37: mol_type = transcribed RNA
gtttccaagcaatagctcgtggcgttatgatttctgt

SEQ ID NO: 915 - RNA, 37 nt, Sutterella wadsworthensis
  source 1..37: mol_type = transcribed RNA
ggtgatttcctatagctcatagcgttatgatctctaa

SEQ ID NO: 916 - RNA, 37 nt, Legionella pneumophila; identical to SEQ ID NO: 872
  source 1..37: mol_type = transcribed RNA

SEQ ID NO: 917 - RNA, 36 nt, Listeria innocua; identical to SEQ ID NO: 862
  source 1..36: mol_type = transcribed RNA

SEQ ID NO: 918 - RNA, 36 nt, Streptococcus thermophilus; identical to SEQ ID NO: 860
  source 1..36: mol_type = transcribed RNA

SEQ ID NO: 919 - RNA, 36 nt, Streptococcus mutans; identical to SEQ ID NO: 859
  source 1..36: mol_type = transcribed RNA

SEQ ID NO: 920 - RNA, 36 nt, Streptococcus pyogenes; identical to SEQ ID NO: 858
  source 1..36: mol_type = transcribed RNA

SEQ ID NO: 921 - RNA, 36 nt, Fusobacterium nucleatum
  source 1..36: mol_type = transcribed RNA
atttttaatttaagtaataaaaaatggagcatatac

SEQ ID NO: 922 - RNA, 36 nt, Filifactor alocis
  source 1..36: mol_type = transcribed RNA
agttgactaccatatgagattacactacacggttca

SEQ ID NO: 923 - RNA, 36 nt, Treponema denticola; identical to SEQ ID NO: 864
  source 1..36: mol_type = transcribed RNA

SEQ ID NO: 924 - RNA, 36 nt, Solobacterium moorei
  source 1..36: mol_type = transcribed RNA
cttataccagtaagataatttacatagtaagttcaa

SEQ ID NO: 925 - RNA, 36 nt, Veillonella atypica
  source 1..36: mol_type = transcribed RNA
gttttggaggtttacagaattacactacgagttcaa

SEQ ID NO: 926 - RNA, 36 nt, Finegoldia magna
  source 1..36: mol_type = transcribed RNA
gtttaatacctatatgagattacatcatgagttcaa

SEQ ID NO: 927 - RNA, 36 nt, Olsenella uli; identical to SEQ ID NO: 889
  source 1..36: mol_type = transcribed RNA

SEQ ID NO: 928 - RNA, 36 nt, Lactobacillus rhamnosus
  source 1..36: mol_type = transcribed RNA
caacttgaattgattgatctgacatctacgagttga

SEQ ID NO: 929 - RNA, 36 nt, Lactobacillus gasseri
  source 1..36: mol_type = transcribed RNA
tgattagatttcattgatctaacagccatctaaaac

SEQ ID NO: 930 - RNA, 36 nt, Lactobacillus gasseri
  source 1..36: mol_type = transcribed RNA
acactaaactttattgatctaacaaccagatttaaa

SEQ ID NO: 931 - RNA, 36 nt, Oenococcus kitaharae
  source 1..36: mol_type = transcribed RNA
gggttctacctcattgatctgacacacagcattgaa

SEQ ID NO: 932 - RNA, 36 nt, Bifidobacterium bifidum; identical to SEQ ID NO: 868
  source 1..36: mol_type = transcribed RNA

SEQ ID NO: 933 - RNA, 36 nt, Staphylococcus pseudintermedius
  source 1..36: mol_type = transcribed RNA
gttttacttctttctaaataaacatagttaagttaa

SEQ ID NO: 934 - RNA, 36 nt, Eubacterium rectale
  source 1..36: mol_type = transcribed RNA
attttatagtcacgtaaatttttcagatctactaaa

SEQ ID NO: 935 - RNA, 38 nt, Enterococcus faecalis
  source 1..38: mol_type = transcribed RNA
attttactgataagaaattattgagaatctacaaaaat

SEQ ID NO: 936 - RNA, 36 nt, Streptococcus thermophilus; identical to SEQ ID NO: 861
  source 1..36: mol_type = transcribed RNA

SEQ ID NO: 937 - RNA, 36 nt, Staphylococcus lugdunensis
  source 1..36: mol_type = transcribed RNA
cttgtacttatacctaaaattacagaatctactgaa

SEQ ID NO: 938 - RNA, 36 nt, Eubacterium dolichum
  source 1..36: mol_type = transcribed RNA
atcataatctagcaaaagtttatatgatctaacaaa

SEQ ID NO: 939 - RNA, 36 nt, Mycoplasma mobile; identical to SEQ ID NO: 876
  source 1..36: mol_type = transcribed RNA

SEQ ID NO: 940 - RNA, 36 nt, Mycoplasma ovipneumoniae
  source 1..36: mol_type = transcribed RNA
attttactctagtaagaaattgtcgcacaaaaataa

SEQ ID NO: 941 - RNA, 36 nt, Mycoplasma gallisepticum
  source 1..36: mol_type = transcribed RNA
attattgcttacacaattattgtcgtgctaaaataa

SEQ ID NO: 942 - RNA, 36 nt, Mycoplasma canis
  source 1..36: mol_type = transcribed RNA
attattgtttacccaaatattgtacatcctaaatca

SEQ ID NO: 943 - RNA, 36 nt, Mycoplasma synoviae
  source 1..36: mol_type = transcribed RNA
tacttacttaacaaaataattgtacgattccaaaat

SEQ ID NO: 944 - RNA, 36 nt, Aminomonas paucivorans
  source 1..36: mol_type = transcribed RNA
gccttccctccctgccgaaggagcagatcctctcct

SEQ ID NO: 945 - RNA, 36 nt, Clostridium perfringens
  source 1..36: mol_type = transcribed RNA
ttatagtaactagttaaactctcgatatgctatacc

SEQ ID NO: 946 - RNA, 36 nt, Clostridium cellulolyticum
  source 1..36: mol_type = transcribed RNA
attatagcaacaattcaggctccgatatgccataat

SEQ ID NO: 947 - RNA, 36 nt, Acidovorax ebreus; identical to SEQ ID NO: 878
  source 1..36: mol_type = transcribed RNA

SEQ ID NO: 948 - RNA, 36 nt, Neisseria meningitidis; identical to SEQ ID NO: 865
  source 1..36: mol_type = transcribed RNA

SEQ ID NO: 949 - RNA, 36 nt, Pasteurella multocida
  source 1..36: mol_type = transcribed RNA
attgttgcactgcgaaatgagagacgttgctacaat

SEQ ID NO: 950 - RNA, 36 nt, Endomicrobium trichonymphae
  source 1..36: mol_type = transcribed RNA
tttgtaacttatctgagagaggatggttattataat

SEQ ID NO: 951 - RNA, 36 nt, Wolinella succinogenes; identical to SEQ ID NO: 879
  source 1..36: mol_type = transcribed RNA

SEQ ID NO: 952 - RNA, 36 nt, Campylobacter jejuni
  source 1..36: mol_type = transcribed RNA
ataatacaaaaatcatttttttaaacaaacataaac

SEQ ID NO: 953 - RNA, 36 nt, Campylobacter jejuni
  source 1..36: mol_type = transcribed RNA
tataatctcataagaaatttaaaaagggactaaaat

SEQ ID NO: 954 - RNA, 36 nt, Helicobacter mustelae
  source 1..36: mol_type = transcribed RNA
gtatttgtcaataaatatactttataatggcaagat

SEQ ID NO: 955 - RNA, 36 nt, Roseburia intestinalis
  source 1..36: mol_type = transcribed RNA
ttgtaataacctaattatcacttggtatgatataat

SEQ ID NO: 956 - RNA, 36 nt, Lactobacillus coryniformis
  source 1..36: mol_type = transcribed RNA
ttttattctatagtaagttttcagctaaaatagatc

SEQ ID NO: 957 - RNA, 36 nt, Rhodopseudomonas palustris; identical to SEQ ID NO: 888
  source 1..36: mol_type = transcribed RNA

SEQ ID NO: 958 - RNA, 36 nt, Candidatus Puniceispirillum marinum
  source 1..36: mol_type = transcribed RNA; strain = Candidatus Puniceispirillum marinum IMCC1322
taaccataggctcctcaatcaccagagtgttattgc

SEQ ID NO: 959 - RNA, 36 nt, Verminephrobacter eiseniae; identical to SEQ ID NO: 893
  source 1..36: mol_type = transcribed RNA

SEQ ID NO: 960 - RNA, 36 nt, Ralstonia syzygii
  source 1..36: mol_type = transcribed RNA
gttagtagcaaagcgcaattcccgatctgctggaaa

SEQ ID NO: 961 - RNA, 36 nt, Azospirillum sp.
  source 1..36: mol_type = transcribed RNA; strain = Azospirillum B510
ttaacggctggacccccgatccccatcgaatttcca

SEQ ID NO: 962 - RNA, 36 nt, Dinoroseobacter shibae; identical to SEQ ID NO: 892
  source 1..36: mol_type = transcribed RNA

SEQ ID NO: 963 - RNA, 36 nt, Rhodospirillum rubrum; identical to SEQ ID NO: 890
  source 1..36: mol_type = transcribed RNA

SEQ ID NO: 964 - RNA, 36 nt, Rhodospirillum rubrum; identical to SEQ ID NO: 891
  source 1..36: mol_type = transcribed RNA

SEQ ID NO: 965 - RNA, 36 nt, Sphaerochaeta globosa
  source 1..36: mol_type = transcribed RNA; strain = Sphaerochaeta globosa str. Buddy
attagagataatcgctggtttttgttaagatataac

SEQ ID NO: 966 - RNA, 36 nt, Prevotella ruminicola; identical to SEQ ID NO: 882
  source 1..36: mol_type = transcribed RNA

SEQ ID NO: 967 - RNA, 36 nt, Flavobacterium columnare
  source 1..36: mol_type = transcribed RNA
agataaaattattctaatctttaatcttatcacaat

SEQ ID NO: 968 - RNA, 36 nt, Parvibaculum lavamentivorans
  source 1..36: mol_type = transcribed RNA
cttgcgaaaagcgaccgcctctcgatttgctacaga

SEQ ID NO: 969 - RNA, 44 nt, Capnocytophaga ochracea; identical to SEQ ID NO: 877
  source 1..44: mol_type = transcribed RNA

SEQ ID NO: 970 - RNA, 48 nt, Fibrobacter succinogenes; identical to SEQ ID NO: 883
  source 1..48: mol_type = transcribed RNA

SEQ ID NO: 971 - RNA, 36 nt, Nitratifractor salsuginis; identical to SEQ ID NO: 873
  source 1..36: mol_type = transcribed RNA

SEQ ID NO: 972 - RNA, 36 nt, Akkermansia muciniphila
  source 1..36: mol_type = transcribed RNA
cttatacgggaactccacgataaggcattttacatg

SEQ ID NO: 973 - RNA, 88 nt, synthetic construct
  misc_feature 1..88: note = Synthetic Sequence
  source 1..88: mol_type = other RNA
ttggaaccattcaaaacagcatagcaagttaaaataaggctagtccgttatcaacttgaaaaagtggcaccgagtcggtgcttttttt

SEQ ID NO: 974 - RNA, 77 nt, synthetic construct
  misc_feature 1..77: note = Synthetic Sequence
  source 1..77: mol_type = other RNA
caaaacagcatagcaagttaaaataaggctagtccgttatcaacttgaaaaagtggcaccgagtcggtgcttttttt

SEQ ID NO: 975 - RNA, 61 nt, synthetic construct
  misc_feature 1..61: note = Synthetic Sequence
  source 1..61: mol_type = other RNA
caaaacagcatagcaagttaaaataaggctagtccgttatcaacttgaaaaagtttttttt

SEQ ID NO: 976 - RNA, 44 nt, synthetic construct
  misc_feature 1..44: note = Synthetic Sequence
  source 1..44: mol_type = other RNA
caaaacagcatagcaagttaaaataaggctagtccgtttttttt

SEQ ID NO: 977 - RNA, 72 nt, synthetic construct
  misc_feature 1..72: note = Synthetic Sequence
  source 1..72: mol_type = other RNA
caaaacagcatagcaagttaaaataaggctagtccggttcactgccgtataggcagctaagaaatttttttt

SEQ ID NO: 978 - RNA, 14 nt, synthetic construct
  misc_feature 1..14: note = Synthetic Sequence
  source 1..14: mol_type = other RNA
tagcaagttaaaat

SEQ ID NO: 979 - RNA, 102 nt, synthetic construct
  misc_feature 1..102: note = Synthetic Sequence
  misc_difference 1..80: note = n is a, c, g, or u
  source 1..102: mol_type = other RNA
nnnnnnnnnnnnnnnnnnnnnnnnnnnnnnnnnnnnnnnnnnnnnnnnnnnnnnnnnnnnnnnnnnnnnnnnnnnnnnnngttttagagctatgctgttttg

SEQ ID NO: 980 - RNA, 102 nt, synthetic construct
  misc_feature 1..102: note = Synthetic Sequence
  misc_difference 1..80: note = n is a, c, g, or u
  source 1..102: mol_type = other RNA
nnnnnnnnnnnnnnnnnnnnnnnnnnnnnnnnnnnnnnnnnnnnnnnnnnnnnnnnnnnnnnnnnnnnnnnnnnnnnnnngttttagagctatgttattttg

SEQ ID NO: 981 - RNA, 92 nt, unidentified
  misc_difference 1..80: note = n is a, c, g, or u
  source 1..92: mol_type = transcribed RNA
nnnnnnnnnnnnnnnnnnnnnnnnnnnnnnnnnnnnnnnnnnnnnnnnnnnnnnnnnnnnnnnnnnnnnnnnnnnnnnnngttttagagcta

SEQ ID NO: 982 - RNA, 152 nt, synthetic construct
  misc_feature 1..152: note = Synthetic Sequence
  misc_difference 37..116: note = n is a, c, g, or u
  source 1..152: mol_type = other RNA
gttttagagctatgctgttttgaatggtcccaaaacnnnnnnnnnnnnnnnnnnnnnnnnnnnnnnnnnnnnnnnnnnnnnnnnnnnnnnnnnnnnnnnnnnnnnnnnnnnnnnnngttttagagctatgctgttttgaatggtcccaaaac

SEQ ID NO: 983 - RNA, 188 nt, synthetic construct
  misc_feature 1..188: note = Synthetic Sequence
  misc_difference 37..116: note = n is a, c, g, or u
  source 1..188: mol_type = other RNA
gttttagagctatgctgttttgaatggtcccaaaacnnnnnnnnnnnnnnnnnnnnnnnnnnnnnnnnnnnnnnnnnnnnnnnnnnnnnnnnnnnnnnnnnnnnnnnnnnnnnnnngttttagagctatgctgttttgaatggtcccaaaacgttttagagctatgctgttttgaatggtcccaaaac

SEQ ID NO: 984 - RNA, 22 nt, unidentified
  source 1..22: mol_type = transcribed RNA
gttttagagctatgctgttttg

SEQ ID NO: 985 - RNA, 36 nt, Streptococcus pyogenes
  source 1..36: mol_type = transcribed RNA
gttttagagctatgctgttttgaatggtcccaaaac

SEQ ID NO: 986 - RNA, 36 nt, Pasteurella multocida
  source 1..36: mol_type = transcribed RNA
gttgtagttccctctctcatttcgcagtgctacaat

SEQ ID NO: 987 - RNA, 36 nt, Mycoplasma mobile
  source 1..36: mol_type = transcribed RNA
gttttggtgtagtatcattcttatgtattcttaaac

SEQ ID NO: 988 - RNA, 37 nt, Francisella tularensis
  source 1..37: mol_type = transcribed RNA; sub_species = Francisella novicida
gtttcagttgctgaattatttggtaaactactgttag

SEQ ID NO: 989 - RNA, 33 nt, Francisella tularensis
  source 1..33: mol_type = transcribed RNA; sub_species = Francisella novicida
gtttcagttgctgaattatttggtaaactactg

SEQ ID NO: 990 - RNA, 36 nt, Streptococcus mutans
  source 1..36: mol_type = transcribed RNA
gttttagagctgtgttgtttcgaatggttccaaaac

SEQ ID NO: 991 - RNA, 36 nt, Streptococcus thermophilus; identical to SEQ ID NO: 990
  source 1..36: mol_type = transcribed RNA

SEQ ID NO: 992 - RNA, 36 nt, Streptococcus thermophilus
  source 1..36: mol_type = transcribed RNA
gtttttgtactctcaagatttaagtaactgtacaac

SEQ ID NO: 993 - RNA, 36 nt, Listeria innocua
  source 1..36: mol_type = transcribed RNA
gttttagagctatgttattttgaatgctaacaaaac

SEQ ID NO: 994 - RNA, 36 nt, Treponema denticola
  source 1..36: mol_type = transcribed RNA
gtttgagagttgtgtaatttaagatggatctcaaac

SEQ ID NO: 995 - RNA, 36 nt, Neisseria meningitidis
  source 1..36: mol_type = transcribed RNA
gttgtagctccctttctcatttcgcagtgctacaat

SEQ ID NO: 996 - RNA, 36 nt, Streptococcus gordonii; identical to SEQ ID NO: 992
  source 1..36: mol_type = transcribed RNA

SEQ ID NO: 997 - RNA, 35 nt, Bifidobacterium bifidum
  source 1..35: mol_type = transcribed RNA
gtttcaatgcctgtcagatcaatgactttgaccac

SEQ ID NO: 998 - RNA, 36 nt, Lactobacillus salivarius
  source 1..36: mol_type = transcribed RNA
gtttcagaagtatgttaaatcaataaggttaagacc

SEQ ID NO: 999 - RNA, 37 nt, Francisella tularensis
  source 1..37: mol_type = transcribed RNA; sub_species = Francisella novicida
ctaacagtagtttaccaaataattcagcaactgaaac

SEQ ID NO: 1000 - RNA, 37 nt, Francisella tularensis; identical to SEQ ID NO: 999
  source 1..37: mol_type = transcribed RNA; sub_species = Francisella novicida

SEQ ID NO: 1001 - RNA, 37 nt, Legionella pneumophila
  source 1..37: mol_type = transcribed RNA
ccaataatccctcatctaaaaatccaaccactgaaac

SEQ ID NO: 1002 - RNA, 36 nt, Nitratifractor salsuginis
  source 1..36: mol_type = transcribed RNA
gttttaagacccctcaaaaccccaccctgttacaat

SEQ ID NO: 1003 - RNA, 36 nt, Butyrivibrio fibrisolvens
  source 1..36: mol_type = transcribed RNA
gttttagtacccgggaaaattaagtgattggaaaac

SEQ ID NO: 1004 - RNA, 36 nt, Streptobacillus moniliformis
  source 1..36: mol_type = transcribed RNA
gatacagattcttggtaaatttgaataatgtgaatg

SEQ ID NO: 1005 - RNA, 36 nt, Mycoplasma mobile; identical to SEQ ID NO: 987
  source 1..36: mol_type = transcribed RNA

SEQ ID NO: 1006 - RNA, 44 nt, Capnocytophaga ochracea
  source 1..44: mol_type = transcribed RNA
tgttatcaatcgcaaaactacaaaatttgaaagcaattcacaac

SEQ ID NO: 1007 - RNA, 36 nt, Acidovorax ebreus
  source 1..36: mol_type = transcribed RNA
agtgtagctatccggggtgagagagggagctacaac

SEQ ID NO: 1008 - RNA, 36 nt, Wolinella succinogenes
  source 1..36: mol_type = transcribed RNA
attatagcgaggaatggctgagtaggcggctataac

SEQ ID NO: 1009 - RNA, 37 nt, Wolinella succinogenes
  source 1..37: mol_type = transcribed RNA
gcaacactttatagcaaatccgcttagcctgtgaaac

SEQ ID NO: 1010 - RNA, 37 nt, Wolinella succinogenes; identical to SEQ ID NO: 1009
  source 1..37: mol_type = transcribed RNA

SEQ ID NO: 1011 - RNA, 36 nt, Prevotella ruminicola
  source 1..36: mol_type = transcribed RNA
gttgtggtttgatgtaggaaaggaatgatatacaac

SEQ ID NO: 1012 - RNA, 48 nt, Fibrobacter succinogenes
  source 1..48: mol_type = transcribed RNA
gttgttattgcactagtaaaactagaaaatctgaaagcaattcacaac

SEQ ID NO: 1013 - RNA, 36 nt, Campylobacter jejuni
  source 1..36: mol_type = transcribed RNA
attttaccataaagaaatttaaaaagggactaaaac

SEQ ID NO: 1014 - RNA, 36 nt, Campylobacter jejuni
  source 1..36: mol_type = transcribed RNA
gttttagtccctttttaaatttctttatggtaaaat

SEQ ID NO: 1015 - RNA, 36 nt, Pasteurella multocida
  source 1..36: mol_type = transcribed RNA
attgtagcactgcgaaatgagagagggaactacaac

SEQ ID NO: 1016 - RNA, 36 nt, Rhodopseudomonas palustris
  source 1..36: mol_type = transcribed RNA
agcctaccacggggaaatcggtagggaagccacggc

SEQ ID NO: 1017 - RNA, 36 nt, Olsenella uli
  source 1..36: mol_type = transcribed RNA
gttttggggcagtgtcgttttgactggtaatcaaac

SEQ ID NO: 1018 - RNA, 36 nt, Rhodospirillum rubrum
  source 1..36: mol_type = transcribed RNA
actctaccatggcggtgtgggacggggccatggaac

SEQ ID NO: 1019 - RNA, 36 nt, Rhodospirillum rubrum; identical to SEQ ID NO: 1018
  source 1..36: mol_type = transcribed RNA

SEQ ID NO: 1020 - RNA, 36 nt, Dinoroseobacter shibae
  source 1..36: mol_type = transcribed RNA
agtttagctgttcagaattcggggtccagccgcaac

SEQ ID NO: 1021 - RNA, 36 nt, Verminephrobacter eiseniae
  source 1..36: mol_type = transcribed RNA
attgtagctcactgggatatgcgcactggccggaac

SEQ ID NO: 1022 - RNA, 37 nt, Francisella tularensis; identical to SEQ ID NO: 988
  source 1..37: mol_type = transcribed RNA

SEQ ID NO: 1023 - RNA, 37 nt, Francisella tularensis; identical to SEQ ID NO: 988
  source 1..37: mol_type = transcribed RNA; sub_species = Francisella novicida

SEQ ID NO: 1024 - RNA, 37 nt, Wolinella succinogenes; identical to SEQ ID NO: 1009
  source 1..37: mol_type = transcribed RNA

SEQ ID NO: 1025 - RNA, 37 nt, Wolinella succinogenes; identical to SEQ ID NO: 1009
  source 1..37: mol_type = transcribed RNA

SEQ ID NO: 1026 - RNA, 37 nt, unidentified
  source 1..37: mol_type = transcribed RNA; note = gamma proteobacterium
gtttcagagcttatcccaacaaaccaacagctgaaac

SEQ ID NO: 1027 - RNA, 37 nt, unidentified; identical to SEQ ID NO: 1026
  source 1..37: mol_type = transcribed RNA; note = gamma proteobacterium

SEQ ID NO: 1028 - RNA, 37 nt, Sutterella wadsworthensis
  source 1..37: mol_type = transcribed RNA
gcgaagatcataacgctacgagctatagcactgaaac

SEQ ID NO: 1029 - RNA, 37 nt, Sutterella wadsworthensis; identical to SEQ ID NO: 1028
  source 1..37: mol_type = transcribed RNA

SEQ ID NO: 1030 - RNA, 37 nt, Legionella pneumophila; identical to SEQ ID NO: 1001
  source 1..37: mol_type = transcribed RNA

SEQ ID NO: 1031 - RNA, 36 nt, Listeria innocua; identical to SEQ ID NO: 993
  source 1..36: mol_type = transcribed RNA

SEQ ID NO: 1032 - RNA, 36 nt, Streptococcus thermophilus; identical to SEQ ID NO: 990
  source 1..36: mol_type = transcribed RNA

SEQ ID NO: 1033 - RNA, 36 nt, Streptococcus mutans; identical to SEQ ID NO: 990
  source 1..36: mol_type = transcribed RNA

SEQ ID NO: 1034 - RNA, 36 nt, Streptococcus pyogenes; identical to SEQ ID NO: 985
  source 1..36: mol_type = transcribed RNA

SEQ ID NO: 1035 - RNA, 36 nt, Fusobacterium nucleatum
  source 1..36: mol_type = transcribed RNA
gtttgagagtaatgttattttaaatagattcaaaac

SEQ ID NO: 1036 - RNA, 36 nt, Filifactor alocis
  source 1..36: mol_type = transcribed RNA
gtttgagagtagtgtaatttcatatggtagtcaaac

SEQ ID NO: 1037 - RNA, 36 nt, Treponema denticola; identical to SEQ ID NO: 994
  source 1..36: mol_type = transcribed RNA

SEQ ID NO: 1038 - RNA, 36 nt, Solobacterium moorei
  source 1..36: mol_type = transcribed RNA
gtttgagaactatgtaaattatgctggtagcaaaac

SEQ ID NO: 1039 - RNA, 36 nt, Veillonella atypica
  source 1..36: mol_type = transcribed RNA
gtttgcgagtagtgtaattctgtaaatctctaaaac

SEQ ID NO: 1040 - RNA, 36 nt, Finegoldia magna
  source 1..36: mol_type = transcribed RNA
gtttgagaatgatgtaatttcatataggtattaaac

SEQ ID NO: 1041 - RNA, 36 nt, Olsenella uli; identical to SEQ ID NO: 1017
  source 1..36: mol_type = transcribed RNA

SEQ ID NO: 1042 - RNA, 36 nt, Lactobacillus rhamnosus
  source 1..36: mol_type = transcribed RNA
gtctcaggtagatgtcagatcaatcagttcaagagc

SEQ ID NO: 1043 - RNA, 36 nt, Lactobacillus gasseri
  source 1..36: mol_type = transcribed RNA
gttttagatggttgttagatcaataaggtttagatc

SEQ ID NO: 1044 - RNA, 36 nt, Lactobacillus gasseri; identical to SEQ ID NO: 1043
  source 1..36: mol_type = transcribed RNA

SEQ ID NO: 1045 - RNA, 36 nt, Oenococcus kitaharae
  source 1..36: mol_type = transcribed RNA
gcttcagatgtgtgtcagatcaatgaggtagaaccc

SEQ ID NO: 1046 - RNA, 36 nt, Bifidobacterium bifidum
  source 1..36: mol_type = transcribed RNA
gtttcagatgcctgtcagatcaatgactttgaccac

SEQ ID NO: 1047 - RNA, 36 nt, Staphylococcus pseudintermedius
  source 1..36: mol_type = transcribed RNA
gttttagcactatgtttatttagaaagaggtaaaac

SEQ ID NO: 1048 - RNA, 36 nt, Eubacterium rectale
  source 1..36: mol_type = transcribed RNA
attttagtaactgaataatttacgtgactgtaaaac

SEQ ID NO: 1049 - RNA, 36 nt, Enterococcus faecalis
  source 1..36: mol_type = transcribed RNA
gtttttgtattctcaataatttcttatcagtaaaac

SEQ ID NO: 1050 - RNA, 36 nt, Streptococcus thermophilus; identical to SEQ ID NO: 992
  source 1..36: mol_type = transcribed RNA

SEQ ID NO: 1051 - RNA, 36 nt, Staphylococcus lugdunensis
  source 1..36: mol_type = transcribed RNA
gttttagtactctgtaattttaggtataagtgatac

SEQ ID NO: 1052 - RNA, 36 nt, Eubacterium dolichum
  source 1..36: mol_type = transcribed RNA
gttttgttaccatatggatttttgctagattaagac

SEQ ID NO: 1053 - RNA, 36 nt, Mycoplasma mobile; identical to SEQ ID NO: 987
  source 1..36: mol_type = transcribed RNA

SEQ ID NO: 1054 - RNA, 36 nt, Mycoplasma ovipneumoniae
  source 1..36: mol_type = transcribed RNA
gtttttgtgctgtacaatttcttactagagtaaaac

SEQ ID NO: 1055 - RNA, 36 nt, Mycoplasma gallisepticum
  source 1..36: mol_type = transcribed RNA
gttttagcactgtacaatacttgtgtaagcaataac

SEQ ID NO: 1056 - RNA, 36 nt, Mycoplasma canis
  source 1..36: mol_type = transcribed RNA
gttttagtgttgtacaatatttgggtaaacaataac

SEQ ID NO: 1057 - RNA, 36 nt, Mycoplasma synoviae
  source 1..36: mol_type = transcribed RNA
gttttggggttgtacaattattttgttaagtaaaac

SEQ ID NO: 1058 - RNA, 36 nt, Aminomonas paucivorans
  source 1..36: mol_type = transcribed RNA
agcatagcatttcggagtgcggcagggagctatgac

SEQ ID NO: 1059 - RNA, 36 nt, Clostridium perfringens
  source 1..36: mol_type = transcribed RNA
attatagcatatcgagaatttactaggaactataac

SEQ ID NO: 1060 - RNA, 36 nt, Clostridium cellulolyticum
  source 1..36: mol_type = transcribed RNA
attatagcatatcggagcctgaattggagctataac

SEQ ID NO: 1061 - RNA, 36 nt, Acidovorax ebreus; identical to SEQ ID NO: 1007
  source 1..36: mol_type = transcribed RNA

SEQ ID NO: 1062 - RNA, 36 nt, Neisseria meningitidis; identical to SEQ ID NO: 995
  source 1..36: mol_type = transcribed RNA

SEQ ID NO: 1063 - RNA, 36 nt, Pasteurella multocida; identical to SEQ ID NO: 986
  source 1..36: mol_type = transcribed RNA

SEQ ID NO: 1064 - RNA, 36 nt, Endomicrobium trichonymphae
  source 1..36: mol_type = transcribed RNA
gttatagtttccttcctctctcagatgtgctataat

SEQ ID NO: 1065 - RNA, 36 nt, Wolinella succinogenes; identical to SEQ ID NO: 1008
  source 1..36: mol_type = transcribed RNA

SEQ ID NO: 1066 - RNA, 36 nt, Campylobacter jejuni; identical to SEQ ID NO: 1014
  source 1..36: mol_type = transcribed RNA

SEQ ID NO: 1067 - RNA, 36 nt, Campylobacter jejuni; identical to SEQ ID NO: 1014
  source 1..36: mol_type = transcribed RNA

SEQ ID NO: 1068 - RNA, 36 nt, Helicobacter mustelae
  source 1..36: mol_type = transcribed RNA
attttagcataaacatatttatgaagtggctaaaac

SEQ ID NO: 1069 - RNA, 36 nt, Roseburia intestinalis
  source 1..36: mol_type = transcribed RNA
attataccataccaagtgataacagggaattacaac

SEQ ID NO: 1070 - RNA, 36 nt, Lactobacillus coryniformis
  source 1..36: mol_type = transcribed RNA
gatctattttagctgaaaactgaaggaatcaatagc

SEQ ID NO: 1071 - RNA, 36 nt, Rhodopseudomonas palustris; identical to SEQ ID NO: 1016
  source 1..36: mol_type = transcribed RNA

SEQ ID NO: 1072 - RNA, 36 nt, Candidatus Puniceispirillum marinum
  source 1..36: mol_type = transcribed RNA
agtatagcactctggtgattgagagcctagagcaac

SEQ ID NO: 1073 - RNA, 36 nt, Verminephrobacter eiseniae; identical to SEQ ID NO: 1021
  source 1..36: mol_type = transcribed RNA

SEQ ID NO: 1074 - RNA, 36 nt, Ralstonia syzygii
  source 1..36: mol_type = transcribed RNA
aggttagcagatcgggaattgcgctctggctacaac

SEQ ID NO: 1075 - RNA, 36 nt, Azospirillum sp.
  source 1..36: mol_type = transcribed RNA; strain = Azospirillum sp. B510
agtgtagccgatggggatcgggggtccagccgcaac

SEQ ID NO: 1076 - RNA, 36 nt, Dinoroseobacter shibae; identical to SEQ ID NO: 1020
  source 1..36: mol_type = transcribed RNA

SEQ ID NO: 1077 - RNA, 36 nt, Rhodospirillum rubrum; identical to SEQ ID NO: 1018
  source 1..36: mol_type = transcribed RNA

SEQ ID NO: 1078 - RNA, 36 nt, Rhodospirillum rubrum; identical to SEQ ID NO: 1018
  source 1..36: mol_type = transcribed RNA

SEQ ID NO: 1079 - RNA, 36 nt, Sphaerochaeta globosa
  source 1..36: mol_type = transcribed RNA; strain = Sphaerochaeta globosa str. Buddy
ggtcaatcttaacaaaaatcagcggtcatccccaac

SEQ ID NO: 1080 - RNA, 36 nt, Prevotella ruminicola; identical to SEQ ID NO: 1011
  source 1..36: mol_type = transcribed RNA

SEQ ID NO: 1081 - RNA, 36 nt, Flavobacterium columnare
  source 1..36: mol_type = transcribed RNA
gttgtggtttgattaaagattagaaaacacgatatt

SEQ ID NO: 1082 - RNA, 36 nt, Parvibaculum lavamentivorans
  source 1..36: mol_type = transcribed RNA
agagtagcaaatcgagagacggccgcaatccgcagc

SEQ ID NO: 1083 - RNA, 44 nt, Capnocytophaga ochracea; identical to SEQ ID NO: 1006
  source 1..44: mol_type = transcribed RNA

SEQ ID NO: 1084 - RNA, 48 nt, Fibrobacter succinogenes; identical to SEQ ID NO: 1012
  source 1..48: mol_type = transcribed RNA

SEQ ID NO: 1085 - RNA, 36 nt, Nitratifractor salsuginis; identical to SEQ ID NO: 1002
  source 1..36: mol_type = transcribed RNA

SEQ ID NO: 1086 - RNA, 36 nt, Akkermansia muciniphila
  source 1..36: mol_type = transcribed RNA
gttgtactgtgccttattttggattcaaggcaaaac

SEQ ID NO: 1087 - RNA, 44 nt, synthetic construct
  misc_feature 1..44: note = Synthetic Sequence
  source 1..44: mol_type = other RNA
gttttagagctagaaatagcaagttaaaataaggctagtccgtt

SEQ ID NO: 1088 - RNA, 60 nt, synthetic construct
  misc_feature 1..60: note = Synthetic Sequence
  misc_difference 13..17: note = n is a, c, g, or u
  source 1..60: mol_type = other RNA
gttttagagctannnnntagcaagttaaaataagttaaaataaggctagtccgttatcaa

SEQ ID NO: 1089 - RNA, 68 nt, synthetic construct
  misc_feature 1..68: note = Synthetic Sequence
  source 1..68: mol_type = other RNA
gttttagagctatgctgaaaagcatagcaagttaaaaataagttaaaataaggctagtccgttatcaa

SEQ ID NO: 1090 - RNA, 69 nt, synthetic construct
  misc_feature 1..69: note = Synthetic Sequence
  source 1..69: mol_type = other RNA
gttttagagctatgctgttttggaaacaaaacagcatagcaagttaaaataaggctagtccgttatcaa

SEQ ID NO: 1091 - RNA, 70 nt, synthetic construct
  misc_feature 1..70: note = Synthetic Sequence
  source 1..70: mol_type = other RNA
gttttagagctagttttagagctagaaatagcaagttaaaattagcaagttaaaataaggctagtccgtt

SEQ ID NO: 1092 - RNA, 70 nt, synthetic construct
  misc_feature 1..70: note = Synthetic Sequence
  source 1..70: mol_type = other RNA
gttttagagctatagcaagttaaaatgaaagttttagagctatagcaagttaaaataaggctagtccgtt

SEQ ID NO: 1093 - RNA, 74 nt, synthetic construct
  misc_feature 1..74: note = Synthetic Sequence
  source 1..74: mol_type = other RNA
gttttagagctagaaatagcaagttaaaatgttttagagctagaaatagcaagttaaaataaggctagtccgtt

SEQ ID NO: 1094 - RNA, 119 nt, synthetic construct
  misc_feature 1..119: note = Synthetic Sequence
  source 1..119: mol_type = other RNA
gttttagagctatgctgttttggaaacaaaacagcatagcaagttaaaatgttttagagctatgctgttttggaaacaaaacagcatagcaagttaaaataaggctagtccgttatcaa

SEQ ID NO: 1095 - RNA, 12 nt, synthetic construct
  misc_feature 1..12: note = Synthetic Sequence
  source 1..12: mol_type = other RNA
gttttagagcta

SEQ ID NO: 1096 - RNA, 19 nt, synthetic construct
  misc_feature 1..19: note = Synthetic Sequence
  source 1..19: mol_type = other RNA
aatttctactgttgtagat

SEQ ID NO: 1097 - RNA, 19 nt, synthetic construct
  misc_feature 1..19: note = Synthetic Sequence
  source 1..19: mol_type = other RNA
aatttctgctgttgcagat

SEQ ID NO: 1098 - RNA, 19 nt, synthetic construct
  misc_feature 1..19: note = Synthetic Sequence
  source 1..19: mol_type = other RNA
aatttccactgttgtggat

SEQ ID NO: 1099 - RNA, 19 nt, synthetic construct
  misc_feature 1..19: note = Synthetic Sequence
  source 1..19: mol_type = other RNA
aattcctactgttgtaggt

SEQ ID NO: 1100 - RNA, 19 nt, synthetic construct
  misc_feature 1..19: note = Synthetic Sequence
  source 1..19: mol_type = other RNA
aatttctactattgtagat

SEQ ID NO: 1101 - RNA, 19 nt, synthetic construct
  misc_feature 1..19: note = Synthetic Sequence
  source 1..19: mol_type = other RNA
aatttctactgctgtagat

SEQ ID NO: 1102 - RNA, 18 nt, synthetic construct
  misc_feature 1..18: note = Synthetic Sequence
  source 1..18: mol_type = other RNA
aatttctactttgtagat

SEQ ID NO: 1103 - RNA, 17 nt, synthetic construct
  misc_feature 1..17: note = Synthetic Sequence
  source 1..17: mol_type = other RNA
aatttctacttgtagat

SEQ ID NO: 1104 - RNA, 67 nt, synthetic construct
  misc_feature 1..67: note = Synthetic Sequence
  source 1..67: mol_type = other RNA
gaatttttcaacgggtgtgccaatggccactttccaggtggcaaagcccgttgagcttctcaaaaag

SEQ ID NO: 1105 - RNA, 79 nt, synthetic construct
  misc_feature 1..79: note = Synthetic Sequence
  source 1..79: mol_type = other RNA
gtctagaggacagaatttttcaacgggtgtgccaatggccactttccaggtggcaaagcccgttgagcttctcaaaaag

SEQ ID NO: 1106 - RNA, 78 nt, synthetic construct
  misc_feature 1..78: note = Synthetic Sequence
  source 1..78: mol_type = other RNA
tctagaggacagaatttttcaacgggtgtgccaatggccactttccaggtggcaaagcccgttgagcttctcaaaaag

SEQ ID NO: 1107 - RNA, 36 nt, synthetic construct
  misc_feature 1..36: note = Synthetic Sequence
  source 1..36: mol_type = other RNA
actttccaggcaaagcccgttgagcttctcaaaaag

SEQ ID NO: 1108-1109 - skipped (2 entries)

SEQ ID NO: 1110 - RNA, 34 nt, synthetic construct
  misc_feature 1..34: note = Synthetic Sequence
  misc_difference 15..34: note = n is a, c, g, or u
  source 1..34: mol_type = other RNA
ctgagaagtggcacnnnnnnnnnnnnnnnnnnnn

SEQ ID NO: 1111 - RNA, 14 nt, synthetic construct
  misc_feature 1..14: note = Synthetic Sequence
  source 1..14: mol_type = other RNA
ctgagaagtggcac

SEQ ID NO: 1112 - skipped

SEQ ID NO: 1113 - RNA, 13 nt, synthetic construct
  misc_feature 1..13: note = Synthetic Sequence
  source 1..13: mol_type = other RNA
tgagaagtggcac

SEQ ID NO: 1114 - skipped

SEQ ID NO: 1115 - protein, 152 aa, synthetic construct
  REGION 1..152: note = synthetic polypeptide
QRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 1116 - DNA, 36 bp, synthetic construct
  misc_feature 1..36: note = synthetic polynucleotide
  misc_difference 14..18: note = n is a, c, g, or t
  source 1..36: mol_type = other DNA
gctcttccgatctnnnnntcgacccagctgtcggag

SEQ ID NO: 1117 - DNA, 36 bp, synthetic construct
  misc_feature 1..36: note = synthetic polynucleotide
  misc_difference 14..18: note = n is a, c, g, or t
  source 1..36: mol_type = other DNA
gctcttccgatctnnnnntcactgtgtggcttcagg

SEQ ID NO: 1118 - DNA, 41 bp, synthetic construct
  misc_feature 1..41: note = synthetic polynucleotide
  misc_difference 14..18: note = n is a, c, g, or t
  source 1..41: mol_type = other DNA
gctcttccgatctnnnnngctggccttcagttctaaggtag

SEQ ID NO: 1119 - DNA, 40 bp, synthetic construct
  misc_feature 1..40: note = synthetic polynucleotide
  misc_difference 14..18: note = n is a, c, g, or t
  source 1..40: mol_type = other DNA
gctcttccgatctnnnnncgttaatcatattgcgacgggc

SEQ ID NO: 1120 - DNA, 90 bp, synthetic construct
  misc_feature 1..90: note = synthetic polynucleotide
  source 1..90: mol_type = other DNA
gtaaccaaaaccaacgcgaccgttaccatcgccaactacagtcagagctgtgaaggagaaaatacgaccacctacggttttagatacgcg

SEQ ID NO: 1121 - DNA, 90 bp, synthetic construct
  misc_feature 1..90: note = synthetic polynucleotide
  source 1..90: mol_type = other DNA
accgtaaccaaaaccaacgcgaccgttaccatcgccaactacagtcagagctgtgaaggagaaaatacgaccatctttaacggttttaga

SEQ ID NO: 1122 - DNA, 90 bp, synthetic construct
  misc_feature 1..90: note = synthetic polynucleotide
  source 1..90: mol_type = other DNA
aaccaacgcgaccgttaccatcgccaactacagtcagagctgtgaaggagaaaatacgaccacctttaacgttagatacgcggtttaccg

SEQ ID NO: 1123 - DNA, 90 bp, synthetic construct
  misc_feature 1..90: note = synthetic polynucleotide
  source 1..90: mol_type = other DNA
aaccaacgcgaccgttaccatcgccaactacagtcagagctgtgaaggagaaaatacgaccacctttaactttagatacgcggtttaccg

SEQ ID NO: 1124 - DNA, 90 bp, synthetic construct
  misc_feature 1..90: note = synthetic polynucleotide
  source 1..90: mol_type = other DNA
gtgaaggagaaaatacgaccacctttaacggttttagatacgcggatcagcttttcctgcagttcgccagcttgtttttcgatgtgagcc

SEQ ID NO: 1125 - DNA, 20 bp, synthetic construct
  misc_feature 1..20: note = synthetic polynucleotide
  source 1..20: mol_type = other DNA
ttgctggccgtacattaata

SEQ ID NO: 1126 - DNA, 20 bp, synthetic construct
  misc_feature 1..20: note = synthetic polynucleotide
  source 1..20: mol_type = other DNA
acattaatacggctccgcag

SEQ ID NO: 1127 - DNA, 20 bp, synthetic construct
  misc_feature 1..20: note = synthetic polynucleotide
  source 1..20: mol_type = other DNA
tgatattgatttgctggtta

SEQ ID NO: 1128 - DNA, 20 bp, synthetic construct
  misc_feature 1..20: note = synthetic polynucleotide
  source 1..20: mol_type = other DNA
tgccttggtaggtccagcgg

SEQ ID NO: 1129 - DNA, 20 bp, synthetic construct
  misc_feature 1..20: note = synthetic polynucleotide
  source 1..20: mol_type = other DNA
gcatggaaacagttacaggg

SEQ ID NO: 1130 - DNA, 20 bp, synthetic construct
  misc_feature 1..20: note = synthetic polynucleotide
  source 1..20: mol_type = other DNA
gtatctaaaaccgttaaagg

SEQ ID NO: 1131 - DNA, 20 bp, synthetic construct
  misc_feature 1..20: note = synthetic polynucleotide
  source 1..20: mol_type = other DNA
gttcgttaccacaccgtacg

SEQ ID NO: 1132 - DNA, 20 bp, synthetic construct
  misc_feature 1..20: note = synthetic polynucleotide
  source 1..20: mol_type = other DNA
gctctgactgtagttggcga

SEQ ID NO: 1133 - DNA, 20 bp, synthetic construct
  misc_feature 1..20: note = synthetic polynucleotide
  source 1..20: mol_type = other DNA
agcagcgatccagaaagcga

SEQ ID NO: 1134 - DNA, 20 bp, synthetic construct
  misc_feature 1..20: note = synthetic polynucleotide
  source 1..20: mol_type = other DNA
ggtaccggtatcatcgccgg

SEQ ID NO: 1135 - DNA, 20 bp, synthetic construct
  misc_feature 1..20: note = Synthetic Sequence
  source 1..20: mol_type = other DNA
ttccaccaacccgatcaacg

SEQ ID NO: 1136 - DNA, 20 bp, synthetic construct
  misc_feature 1..20: note = Synthetic Sequence
  source 1..20: mol_type = other DNA
aatccgttgaagaaattctg

SEQ ID NO: 1137 - DNA, 2836 bp, synthetic construct
  misc_feature 1..2836: note = Synthetic Sequence
  source 1..2836: mol_type = other DNA
aacggatttacggctagctcagtcctaggtacaatgctagcgctagcaaagaggagaaaagatctatgcgctcacgcaactggtcccgcaccttgaccgaacgcagcggtggtaacggcgcagtggcggttttcatggcttgttatgactgtttttttggggtacagtctatgcctcgcgcatccaagcagcaagcgcgttacgccgtgggtcgatgtttgatgttatggagcagcaacgatgttacgcagcagggcagtcgccctaaaacaaagttaaacattatgcgcgaagcggtgatcgccgaagtatcgacccagctgtcggaggtggtgggggtcattgaacgtcacctggaaccgaccttgctggccgtacattaatacggctccgcagtggatggcggcctgaagccacacagtgatattgatttgctggttacggtgaccgtacgccttgatgaaacaacgcgccgcgctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcgggtatcttcgagccagccacgatcgacattgatctggctatcttgctgacaaaagcacgcgaacatagcgttgccttggtaggtccagcggcggaggaactctttgatccggttcctgaacaggatctgtttgaggcgctgaatgaaaccttaacgctgtggaactcgccgcccgactgggctggcgatgagcgcaatgtagtgcttacgttgtcccgcatttggtacagcgcagtaaccggcaaaatcgcgccgaaggatgtcgctgccgactgggcaatggagcgcctgccggcccagtatcagcccgtcattcttgaagctcgccaggcttatcttggacaagaagaagatcgcttggcctcgcgcgcagatcagttggaagaatttgtccactacgtgaaaggcgagatcaccaaggtagtcggcaaataaggatcctaactcgagctcggtaccaaattccagaaaagaggcctcccgaaaggggggccttttttcgttttggtccgctgccaatgagacgacggggtcatcacggctcatcatgcgccaaacaaatgtgtgcaatacacgctcggatgactgcatgatgaccgcactgactggggacagcagatccacctaagcctgtgagagaagcagacacccgacagatcaaggcagttaactagtgcactgcagtacagcggccgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttttgacagctagctcagtcctaggtataatgctagcgttaataaggagaaggaaaagtatgggtcaaagtagcgatgaagccaacgctcccgttgcagggcagtttgcgcttcccctgagtgccacctttggcttaggggatcgcgtacgcaagaaatctggtgccgcttggcagggtcaagtcgtcggttggtattgcacaaaactcactcctgaaggctatgcggtagagtccgaatcccacccaggctcagtgcaaatttatcctgtggctgcacttgaacgtgtggcctaaactgctcccggtcacactagaaaataaaaacagccgtgcctctttctggcaacggctgtttttatttattcaaccttaattaaggacagctattgtagataagtggggatactacgggtataaaaaaacccgccggggcgggtttttttacgttgcttcagagcggccgcccctgaattcgcatctagatggtagagccacaaacagccggtacaagcaacgatctccaggaccatctgaatcatgcgcggatgacacgaactcacgacggcgatcacagacattaacccacagtacagacactgcgacaacgtggcaattcgtcgcaataccgtctcactgaactggccgataattgcagacg

SEQ ID NO: 1138 - DNA, 2836 bp, synthetic construct
  misc_feature 1..2836: note = Synthetic Sequence
  source 1..2836: mol_type = other DNA
aacggatttacggctagctcagtcctaggtacaatgctagcgctagcaaagaggagaaaagatctatgcgctcacgcaactggtcccgcaccttgaccgaacgcagcggtggtaacggcgcagtggcggttttcatggcttgttatgactgtttttttggggtacagtctatgcctcgcgcatccaagcagcaagcgcgttacgccgtgggtcgatgtttgatgttatggagcagcaacgatgttacgcagcagggcagtcgccctaaaacaaagttaaacattatgcgcgaagcggtgatcgccgaagtatcgacccagctgtcggaggtggtgggggtcattgaacgtcacctgtaaccgaccttgctggccgtacattaatacggctccgcagtggatggcggcctgaagccacacagtgatattgatttgctggttacggtgaccgtacgccttgatgaaacaacgcgccgcgctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcgggtatcttcgagccagccacgatcgacattgatctggctatcttgctgacaaaagcacgcgaacatagcgttgccttggtaggtccagcggcggaggaactctttgatccggttcctgaacaggatctgtttgaggcgctgaatgaaaccttaacgctgtggaactcgccgcccgactgggctggcgatgagcgcaatgtagtgcttacgttgtcccgcatttggtacagcgcagtaaccggcaaaatcgcgccgaaggatgtcgctgccgactgggcaatggagcgcctgccggcccagtatcagcccgtcattcttgaagctcgccaggcttatcttggacaagaagaagatcgcttggcctcgcgcgcagatcagttggaagaatttgtccactacgtgaaaggcgagatcaccaaggtagtcggcaaataaggatcctaactcgagctcggtaccaaattccagaaaagaggcctcccgaaaggggggccttttttcgttttggtccgctgccaatgagacgacggggtcatcacggctcatcatgcgccaaacaaatgtgtgcaatacacgctcggatgactgcatgatgaccgcactgactggggacagcagatccacctaagcctgtgagagaagcagacacccgacagatcaaggcagttaactagtgcactgcagtacagcggccgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttttgacagctagctcagtcctaggtataatgctagcgttaataaggagaaggaaaagtatgggtcaaagtagcgatgaagccaacgctcccgttgcagggcagtttgcgcttcccctgagtgccacctttggcttaggggatcgcgtacgcaagaaatctggtgccgcttggcagggtcaagtcgtcggttggtattgcacaaaactcactcctgaaggctatgcggtagagtccgaatcccacccaggctcagtgcaaatttatcctgtggctgcacttgaacgtgtggcctaaactgctcccggtcacactagaaaataaaaacagccgtgcctctttctggcaacggctgtttttatttattcaaccttaattaaggacagctattgtagataagtggggatactacgggtataaaaaaacccgccggggcgggtttttttacgttgcttcagagcggccgcccctgaattcgcatctagatggtagagccacaaacagccggtacaagcaacgatctccaggaccatctgaatcatgcgcggatgacacgaactcacgacggcgatcacagacattaacccacagtacagacactgcgacaacgtggcaattcgtcgcaataccgtctcactgaactggccgataattgcagacg

SEQ ID NO: 1139 - DNA, 4639 bp, synthetic construct
  misc_feature 1..4639: note = Synthetic Sequence
  misc_difference 35^36: note = Insert 20 nucleotide gRNA protospacer between positions 35 and 36.
  misc_difference 1260^1261: note = Insert Cas9 variant sequence between positions 1260 and 1261.
  misc_difference 1330^1331: note = Insert DNA polymerase variant sequence between positions 1330 and 1331.
  source 1..4639: mol_type = other DNA
tttatagctagctcagcccttggtacaatgctagcgttttagagctagaaatagcaagttaaaataaggctagtccgttatcaacttgaaaaagtggcaccgagtcggtgctttttttgaagcttgggcccgaacaaaaactcatctcagaagaggatctgaatagcgccgtcgaccatcatcatcatcatcattgagtttaaacggactccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgttttatctgttgtttgtcggtgaacgacagggctgccaaaccagatgtcaacacagctacaacgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaagatctatgtggttctagtgaaaccccgggaacaagtgagtcggccacccctgaaggtggatcagggggtagcggatcctaataatggcctcggtaccaaagacgaacaataagacgctgaaaagcgtcttttttcgttttggtccgctgagcagttacagagatgttacgaaccactagtgcactgcagtacagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcaggagttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccttctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatccctgaattcgcatctagactgaactggccgataattgcagacgaacggatttactttacagctagctcagtcctaggtattatgctagcgctagcaaagaggagaaaagatctatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttaaccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggatcctaactcgagctcggtaccaaattccagaaaagaggcctcccgaaaggggggccttttttcgttttggtccgctgccaaaccagatgtcaacacagctacaacg

SEQ ID NO: 1140 - DNA, 9777 bp, synthetic construct
  misc_feature 1..9777: note = Synthetic Sequence
  misc_difference 35^36: note = Insert 20 nucleotide gRNA protospacer between positions 35 and 36.
  misc_difference 1260^1261: note = Insert Phi29 variant sequence between positions 1260 and 1261.
  source 1..9777: mol_type = other DNA
tttatagctagctcagcccttggtacaatgctagcgttttagagctagaaatagcaagttaaaataaggctagtccgttatcaacttgaaaaagtggcaccgagtcggtgctttttttgaagcttgggcccgaacaaaaactcatctcagaagaggatctgaatagcgccgtcgaccatcatcatcatcatcattgagtttaaacggactccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgttttatctgttgtttgtcggtgaacgacagggctgccaaaccagatgtcaacacagctacaacgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaagatctatgggttctagtgaaaccccgggaacaagtgagtcggccacccctgaaggtggatcagggggtagcggatccgttcagatcccgcagaacccgctgattctggttgacggatctagttacctgtaccgtgcttaccatgctttcccgcctttgaccaattctgctggtgaacctacgggagctatgtacggagttctgaatatgttgcgttctttaattatgcagtacaagcctacccacgctgctgttgttttcgatgctaaaggtaagacgttccgcgacgagttattcgagcactataagtctcaccgtcctccgatgcctgatgacttacgcgctcagattgagccgctgcatgctatggtgaaggctatgggtttacctcttttggctgtcagcggtgttgaggctgatgatgtcattggcaccttagctcgtgaggctgagaaggctggtcgccctgttttgatttctaccggtgacaaggacatggctcaattggttaccccgaacatcaccctgatcaacaccatgaccaacacgattctgggtcctgaggaagttgttaacaaatatggtgttcctccggagttgattattgactttcttgctcttatgggcgattcttcagacaatatcccgggtgttccaggtgttggagagaagactgctcaagctctgcttcagggtctgggtggtttggacaccctttacgctgaaccggagaagatcgccggtctgtcttttcgcggtgctaagaccatggctgctaaactggaacagaataaggaggtcgcatacctgtcttatcaattggctaccatcaagacggatgtggagttagaacttacgtgcgagcagcttgaggttcaacagcctgctgctgaggaactgctgggtctttttaagaaatacgaatttaagcgttggaccgccgacgttgaggctggtaagtggctgcaagctaagggtgctaagccggctgctaaaccgcaagaaacgagtgtcgctgatgaggctccggaggttaccgctaccgttatcggttctagtgaaaccccgggaacaagtgagtcggccacccctgaaggtggatcagggggtagcggatccgacaagaagtattctatcggactggctatcgggactaatagcgtcgggtgggccgtgatcactgacgagtacaaggtgccctctaagaagttcaaggtgctcgggaacaccgaccggcattccatcaagaaaaatctgatcggagctctcctctttgattcaggggaaaccgctgaagcaacccgcctcaagcggactgctagacggcggtacaccaggaggaagaaccggatttgttaccttcaagagatattctccaacgaaatggcaaaggtcgacgacagcttcttccataggctggaagaatcattcctcgtggaagaggataagaagcatgaacggcatcccatcttcggtaatatcgtcgacgaggtggcctatcacgagaaatacccaaccatctaccatcttcgcaaaaagctggtggactcaaccgacaaggcagacctccggcttatctacctggccctggcccacatgatcaagttcagaggccacttcctgatcgagggcgacctcaatcctgacaatagcgatgtggataaactgttcatccagctggtgcagacttacaaccagctctttgaagagaaccccatcaatgcaagcggagtcgatgccaaggccattctgtcagcccggctgtcaaagagccgcagacttgagaatcttatcgctcagctgccgggtgaaaagaaaaatggactgttcgggaacctgattgctctttcacttgggctgactcccaatttcaagtctaatttcgacctggcagaggatgccaagctgcaactgtccaaggacacctatgatgacgatctcgacaacctcctggcccagatcggtgaccaatacgccgaccttttccttgctgctaagaatctttctgacgccatcctgctgtctgacattctccgcgtgaacactgaaatcaccaaggcccctctttcagcttcaatgattaagcggtatgatgagcaccaccaggacctgaccctgcttaaggcactcgtccggcagcagcttccggagaagtacaaggaaatcttctttgaccagtcaaagaatggatacgccggctacatcgacggaggtgcctcccaagaggaattttataagtttatcaaacctatccttgagaagatggacggcaccgaagagctcctcgtgaaactgaatcgggaggatctgctgcggaagcagcgcactttcgacaatgggagcattccccaccagatccatcttggggagcttcacgccatccttcggcgccaagaggacttctacccctttcttaaggacaacagggagaagattgagaaaattctcactttccgcatcccctactacgtgggacccctcgccagaggaaatagccggtttgcttggatgaccagaaagtcagaagaaactatcactccctggaacttcgaagaggtggtggacaagggagccagcgctcagtcattcatcgaacggatgactaacttcgataagaacctccccaatgagaaggtcctgccgaaacattccctgctctacgagtactttaccgtgtacaacgagctgaccaaggtgaaatatgtcaccgaagggatgaggaagcccgcattcctgtcaggcgaacaaaagaaggcaattgtggaccttctgttcaagaccaatagaaaggtgaccgtgaagcagctgaaggaggactatttcaagaaaattgaatgcttcgactctgtggagattagcggggtcgaagatcggttcaacgcaagcctgggtacttaccatgatctgcttaagatcatcaaggacaaggattttctggacaatgaggagaacgaggacatccttgaggacattgtcctgactctcactctgttcgaggaccgggaaatgatcgaggagaggcttaagacctacgcccatctgttcgacgataaagtgatgaagcaacttaaacggagaagatataccggatggggacgccttagccgcaaactcatcaacggaatccgggacaaacagagcggaaagaccattcttgatttccttaagagcgacggattcgctaatcgcaacttcatgcaacttatccatgatgattccctgacctttaaggaggacatccagaaggcccaagtgtctggacaaggtgactcactgcacgagcatatcgcaaatctggctggttcacccgctattaagaagggtattctccagaccgtgaaagtcgtggacgagctggtcaaggtgatgggtcgccataaaccagagaacattgtcatcgagatggccagggaaaaccagactacccagaagggacagaagaacagcagggagcggatgaaaagaattgaggaagggattaaggagctcgggtcacagatccttaaagagcacccggtggaaaacacccagcttcagaatgagaagctctatctgtactaccttcaaaatggacgcgatatgtatgtggaccaagagcttgatatcaacaggctctcagactacgacgtggaccatatcgtccctcagagcttcctcgcagacgactcaattgacaataaggtgctgactcgctcagacaagaaccggggaaagtcagataacgtgccctcagaggaagtcgtgaaaaagatgaagaactattggcgccagcttctgaacgcaaagctgatcactcagcggaagttcgacaatctcactaaggctgagaggggcggactgagcgaactggacaaagcaggattcattaaacggcaacttgtggagactcggcagattactaaacatgtcgcccaaatccttgactcacgcatgaataccaagtacgacgaaaacgacaaacttatccgcgaggtgaaggtgattaccctgaagtccaagctggtcagcgatttcagaaaggactttcaattctacaaagtgcgggagatcaataactatcatcatgctcatgacgcatatctgaatgccgtggtgggaaccgccctgatcaagaagtacccagcactggaaagcgagttcgtgtacggagactacaaggtctacgacgtgcgcaagatgattgccaaatctgagcaggagatcggaaaggccaccgcaaagtacttcttctacagcaacatcatgaatttcttcaagaccgaaatcacccttgcaaacggtgagatccggaaggcgccgctcatcgagactaatggggagactggcgaaatcgtgtgggacaagggcagagatttcgctaccgtgcgcaaagtgctttctatgcctcaagtgaacatcgtgaagaaaaccgaggtgcaaaccggaggcttttctaaggaatcaatcctccccaagcgcaactccgacaagctcattgcaaggaagaaggattgggaccctaagaagtacggcggattcgattcaccaactgtggcttattctgtcctggtcgtggctaaggtggaaaaaggaaagtctaagaagctcaagagcgtgaaggaactgctgggtatcaccattatggagcgcagctccttcgagaagaacccaattgactttctcgaagccaaaggttacaaggaagtcaagaaggaccttatcatcaagctcccaaagtatagcctgttcgaactggagaatgggcggaagcggatgctcgcctccgctggcgaacttcagaagggtaatgagctggctctcccctccaagtacgtgaatttcctctaccttgcaagccattacgagaagctgaaggggagccccgaggacaacgagcaaaagcaactgtttgtggagcagcataagcattatctggacgagatcattgagcagatttccgagttttctaaacgcgtcattctcgctgatgccaacctcgataaagtccttagcgcatacaataagcacagagacaaaccaattcgggagcaggctgagaatatcatccacctgttcaccctcaccaatcttggtgcccctgccgcattcaagtacttcgacaccaccatcgaccggaaacgctatacctccaccaaagaagtgctggacgccaccctcatccaccagagcatcaccggactttacgaaactcggattgacctctcacagctcggaggggattaatggcctcggtaccaaagacgaacaataagacgctgaaaagcgtcttttttcgttttggtccgctgagcagttacagagatgttacgaaccactagtgcactgcagtacagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcaggagttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccttctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatccctgaattcgcatctagactgaactggccgataattgcagacgaacggatttactttacagctagctcagtcctaggtattatgctagcgctagcaaagaggagaaaagatctatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttaaccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggatcctaactcgagctcggtaccaaattccagaaaagaggcctcccgaaaggggggccttttttcgttttggtccgctgccaaaccagatgtcaacacagctacaacg

SEQ ID NO: 1141 - DNA, 4851 bp, synthetic construct
  misc_feature 1..4851: note = Synthetic Sequence
  misc_difference 35^36: note = Insert 20 nucleotide gRNA protospacer between positions 35 and 36.
  misc_difference 247^248: note = Insert 20 nucleotide gRNA protospacer between positions 247 and 248.
  misc_difference 1472^1473: note = Insert Cas9 variant sequence between positions 1472 and 1473.
  misc_difference 1542^1543: note = Insert DNA polymerase variant sequence between positions 1542 and 1543.
  source 1..4851: mol_type = other DNA
tttatagctagctcagcccttggtacaatgctagcgttttagagctagaaatagcaagttaaaataaggctagtccgttatcaacttgaaaaagtggcaccgagtcggtgctttttttctcggtaccaaattccagaaaagaggcctcccgaaaggggggccttttttcgttttggtccgctgccaaaccagatgtcaacacagctacaacgtttatagctagctcagcccttggtacaatgctagcgttttagagctagaaatagcaagttaaaataaggctagtccgttatcaacttgaaaaagtggcaccgagtcggtgctttttttgaagcttgggcccgaacaaaaactcatctcagaagaggatctgaatagcgccgtcgaccatcatcatcatcatcattgagtttaaacggactccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgttttatctgttgtttgtcggtgaacgacagggctgccaaaccagatgtcaacacagctacaacgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaagatctatgtggttctagtgaaaccccgggaacaagtgagtcggccacccctgaaggtggatcagggggtagcggatcctaataatggcctcggtaccaaagacgaacaataagacgctgaaaagcgtcttttttcgttttggtccgctgagcagttacagagatgttacgaaccactagtgcactgcagtacagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcaggagttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccttctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatccctgaattcgcatctagactgaactggccgataattgcagacgaacggatttactttacagctagctcagtcctaggtattatgctagcgctagcaaagaggagaaaagatctatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttaaccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggatcctaactcgagctcggtaccaaattccagaaaagaggcctcccgaaaggggggccttttttcgttttggtccgctgccaaaccagatgtcaacacagctacaacg

SEQ ID NO: 1142 - protein, 1367 aa, synthetic construct
  REGION 1..1367: note = Synthetic Sequence
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1143 - protein, 1367 aa, synthetic construct
  REGION 1..1367: note = Synthetic Sequence
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1144 - protein, 927 aa, synthetic construct
  REGION 1..927: note = Synthetic Sequence
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQIELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1145 - protein, 927 aa, synthetic construct
  REGION 1..927: note = Synthetic Sequence
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQNELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1146 - protein, 927 aa, synthetic construct
  REGION 1..927: note = Synthetic Sequence
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQNELRIMAHLSRDKGLLTAFAEGKDIHRATAAEVFGLPLETVTSEQRRSAKRINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1147 - protein, 927 aa, synthetic construct
  REGION 1..927: note = Synthetic Sequence
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQNELRIMAHLSRDKGLLTAFAEGKDIHRATAAEVYGLPLETVTSEQRRSAKRINFGLIYGMSAFGLARQLNIPRKEAQKYMDLYFERYHGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1148 - protein, 996 aa, synthetic construct
  REGION 1..996: note = Synthetic Sequence
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKATETFGSWYQPKGGTEMFCHPRTGKPLPKYPRIKTPKVGGIFKKPKNKAQREGREPCELDTREYVAGAPYTPVEHVVFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQNELRIMAHLSRDKGLLTAFAEGKDIHRATAAEVFGLPLETVTSEQRRSAKRINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1149 - protein, 574 aa, synthetic construct
  REGION 1..574: note = Synthetic Sequence
KHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 1150 - protein, 574 aa, synthetic construct
  REGION 1..574: note = Synthetic Sequence
KHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKRMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 1151 - protein, 574 aa, synthetic construct
  REGION 1..574: note = Synthetic Sequence
KHMPRKRYSCDFETTTKVEDCRVWAYGYMNIEDHSEYKIGNSLDEFMAWALKVQADLYFHDLKFDGAFIINWLERNGFKWSADGLPNTYNTIISRTGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKDFKDIITTKKFKKVFPTLSLGLDKKVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRPKTYIQDIYMKEVDGKLVEGSPDDYTDIKLSVKCAGMTDKIKKEVTFENFKVGFSRKMKPKPVQVPGGVVLVDDTFTIK

SEQ ID NO: 1152 - protein, 574 aa, synthetic construct
  REGION 1..574: note = Synthetic Sequence
KHMPRKRYSCDFETTTKVEDCRVWAYGYMNIEDHSEYKIGNSLDEFMAWALKVQADLYFHDLKFDGAFIINWLERNGFKWSADGLPNTYNTIISRTGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKDFKDIITTKKFKKVFPTLSLGLDKKVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKRMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRPKTYIQDIYMKEVDGKLVEGSPDDYTDIKLSVKCAGMTDKIKKEVTFENFKVGFSRKMKPKPVQVPGGVVLVDDTFTIK

SEQ ID NO: 1153 - protein, 123 aa, synthetic construct
  REGION 1..123: note = Synthetic Sequence
ENTNIVKATFDTETLEGQIKIFNAQTGGGQSFKNLPDGTIIEANAIAQYKQVSDTYGDAKEETVTTIFAADGSLYSAISKTVAEAASDLIDLVTRHKLETFKVKVVQGTSSKGNVFFSLQLSL

SEQ ID NO: 1154 - protein, 5 aa, synthetic construct
  REGION 1..5: note = Synthetic polypeptide
GSGGS

SEQ ID NO: 1155 - protein, 6 aa, synthetic construct
  REGION 1..6: note = Synthetic polypeptide
GGSGGS

SEQ ID NO: 1156 - protein, 4 aa, synthetic construct
  REGION 1..4: note = Synthetic polypeptide
GGGS

SEQ ID NO: 1157 - protein, 4 aa, synthetic construct
  REGION 1..4: note = Synthetic polypeptide
GGSG

SEQ ID NO: 1158 - protein, 5 aa, synthetic construct
  REGION 1..5: note = Synthetic polypeptide
GGSGG

SEQ ID NO: 1159 - protein, 5 aa, synthetic construct
  REGION 1..5: note = Synthetic polypeptide
GSGSG

SEQ ID NO: 1160 - protein, 5 aa, synthetic construct
  REGION 1..5: note = Synthetic polypeptide
GSGGG

SEQ ID NO: 1161 - protein, 5 aa, synthetic construct
  REGION 1..5: note = Synthetic polypeptide
GGGSG

SEQ ID NO: 1162 - protein, 5 aa, synthetic construct
  REGION 1..5: note = Synthetic polypeptide
GSSSG

SEQ ID NO: 1163 - protein, 335 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 1164 - protein, 740 aa, Homo sapiens
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 1165 - protein, 445 aa, Homo sapiens
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAK

SEQ ID NO: 1166 - protein, 419 aa, Homo sapiens
ELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAK

SEQ ID NO: 1167 - protein, 899 aa, Homo sapiens
ENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIPQYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQEAHQQFARNVLFQTMKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVQALELQLQVPLKVSLSAGRSWGHLVPLQEAWGPPPGPCRTESPSNSLAAPGSPASTQPPPLHFSPSFCL

SEQ ID NO: 1168 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 1169 - protein, 511 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSN

SEQ ID NO: 1170 - protein, 870 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 1171 - protein, 560 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLE

SEQ ID NO: 1172 - protein, 7 aa, synthetic construct
  REGION 1..7: note = Synthetic polypeptide
PKKKRKV

SEQ ID NO: 1173 - protein, 16 aa, synthetic construct
  REGION 1..16: note = Synthetic polypeptide
KRPAATKKAGQAKKKK

SEQ ID NO: 1174 - protein, 9 aa, synthetic construct
  REGION 1..9: note = Synthetic polypeptide
PAAKRVKLD

SEQ ID NO: 1175 - protein, 11 aa, synthetic construct
  REGION 1..11: note = Synthetic polypeptide
RQRRNELKRSP

SEQ ID NO: 1176 - protein, 38 aa, synthetic construct
  REGION 1..38: note = Synthetic polypeptide
NQSSNFGPMKGGNFGGRSSGPYGGGGQYFAKPRNQGGY

SEQ ID NO: 1177 - protein, 42 aa, synthetic construct
  REGION 1..42: note = Synthetic polypeptide
RMRIZFKNKGKDTAELRRRRVEVSVELRKAKKDEQILKRRNV

SEQ ID NO: 1178 - protein, 8 aa, synthetic construct
  REGION 1..8: note = Synthetic polypeptide
VSRKRPRP

SEQ ID NO: 1179 - protein, 8 aa, synthetic construct
  REGION 1..8: note = Synthetic polypeptide
PPKKARED

SEQ ID NO: 1180 - protein, 8 aa, synthetic construct
  REGION 1..8: note = Synthetic polypeptide
PQPKKKPL

SEQ ID NO: 1181 - protein, 12 aa, synthetic construct
  REGION 1..12: note = Synthetic polypeptide
SALIKKKKKMAP

SEQ ID NO: 1182 - protein, 5 aa, synthetic construct
  REGION 1..5: note = Synthetic polypeptide
DRLRR

SEQ ID NO: 1183 - protein, 7 aa, synthetic construct
  REGION 1..7: note = Synthetic polypeptide
PKQKKRK

SEQ ID NO: 1184 - protein, 10 aa, synthetic construct
  REGION 1..10: note = Synthetic polypeptide
RKLKKKIKKL

SEQ ID NO: 1185 - protein, 10 aa, synthetic construct
  REGION 1..10: note = Synthetic polypeptide
REKKKFLKRR

SEQ ID NO: 1186 - protein, 20 aa, synthetic construct
  REGION 1..20: note = Synthetic polypeptide
KRKGDEVDGVDEVAKKKSKK

SEQ ID NO: 1187 - protein, 17 aa, synthetic construct
  REGION 1..17: note = Synthetic polypeptide
RKCLQAGMNLEARKTKK

SEQ ID NO: 1188 - protein, 30 aa, synthetic construct
  REGION 1..30: note = Synthetic polypeptide
MDSLLMNRRKFLYQFKNVRWAKGRRETYLC

SEQ ID NO: 1189 - protein, 11 aa, synthetic construct
  REGION 1..11: note = Synthetic polypeptide
YGRKKRRQRRR

SEQ ID NO: 1190 - protein, 12 aa, synthetic construct
  REGION 1..12: note = Synthetic polypeptide
RRQRRTSKLMKR

SEQ ID NO: 1191 - protein, 27 aa, synthetic construct
  REGION 1..27: note = Synthetic polypeptide
GWTLNSAGYLLGKINLKALAALAKKIL

SEQ ID NO: 1192 - protein, 33 aa, synthetic construct
  REGION 1..33: note = Synthetic polypeptide
KALAWEAKLAKALAKALAKHLAKALAKALKCEA

SEQ ID NO: 1193 - protein, 16 aa, synthetic construct
  REGION 1..16: note = Synthetic polypeptide
RQIKIWFQNRRMKWKK

SEQ ID NO: 1194 - protein, 9 aa, synthetic construct
  REGION 1..9: note = Synthetic polypeptide
RKKRRQRRR

SEQ ID NO: 1195 - protein, 8 aa, synthetic construct
  REGION 1..8: note = Synthetic polypeptide
RKKRRQRR

SEQ ID NO: 1196 - protein, 11 aa, synthetic construct
  REGION 1..11: note = Synthetic polypeptide
YARAAARQARA

SEQ ID NO: 1197 - protein, 11 aa, synthetic construct
  REGION 1..11: note = Synthetic polypeptide
THRLPRRRRRR

SEQ ID NO: 1198 - protein, 11 aa, synthetic construct
  REGION 1..11: note = Synthetic polypeptide
GGRRARRRRRR

SEQ ID NO: 1199 - protein, 75 aa, synthetic construct
  REGION 1..75: note = Synthetic polypeptide
TETFGSWYQPKGGTEMFCHPRTGKPLPKYPRIKTPKVGGIFKKPKNKAQREGREPCELDTREYVAGAPYTPVEHV

SEQ ID NO: 1200 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 1201 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 1202 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 1203 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 1204 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 1205 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 1206 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 1207 - protein, 198 aa, Homo sapiens [sequence omitted]

SEQ ID NO: 1208 - protein, 188 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKENHERTFKAWEGLHENSVRLSRQLRRILLPLYEVDDLRDAFRTLGL

SEQ ID NO: 1209 - protein, 198 aa, Homo sapiens [sequence omitted]

SEQ ID NO: 1210 - protein, 1367 aa, synthetic construct
  REGION 1..1367: note = Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1211 - protein, 1367 aa, synthetic construct; identical to SEQ ID NO: 1143
  REGION 1..1367: note = Synthetic polypeptide

SEQ ID NO: 1212 - protein, 1367 aa, synthetic construct; identical to SEQ ID NO: 1142
  REGION 1..1367: note = Synthetic polypeptide

SEQ ID NO: 1213 - protein, 83 aa, synthetic construct
  REGION 1..83: note = Synthetic polypeptide
TNLSDIIEKETGKQLVIQESILMLPEEVEEVIGNKPESDILVHTAYDESTDENVMLLTSDAPEYKPWALVIQDSNGENKIKML

SEQ ID NO: 1214 - protein, 196 aa, synthetic construct
  REGION 1..196: note = Synthetic sequence
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 1215 - protein, 18 aa, synthetic construct
  REGION 1..18: note = Synthetic sequence
WPTLVTTLTHGVQCFSRY

SEQ ID NO: 1216 - DNA, 54 bp, synthetic construct
  misc_feature 1..54: note = Synthetic sequence
  source 1..54: mol_type = other DNA
tggcccaccctcgtgaccaccctgacccatggcgtgcagtgcttcagccgctac

SEQ ID NO: 1217 - protein, 18 aa, synthetic construct
  REGION 1..18: note = Synthetic sequence
WPTLVTTLTYGVQCFSRY

SEQ ID NO: 1218 - DNA, 54 bp, synthetic construct
  misc_feature 1..54: note = Synthetic sequence
  source 1..54: mol_type = other DNA
tggcccaccctcgtgaccaccctgacctatggcgtgcagtgcttcagccgctac

SEQ ID NO: 1219 - protein, 1368 aa, Streptococcus pyogenes [sequence omitted]

SEQ ID NO: 1220 - protein, 1368 aa, synthetic construct
  REGION 1..1368: note = Synthetic sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1221 - protein, 1368 aa, synthetic construct
  REGION 1..1368: note = Synthetic sequence
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1222 - protein, 1368 aa, synthetic construct
  REGION 1..1368: note = Synthetic sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1223 - protein, 1368 aa, synthetic construct
  REGION 1..1368: note = Synthetic sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1224 - protein, 1053 aa, Staphylococcus aureus; identical to SEQ ID NO: 249

SEQ ID NO: 1225 - protein, 1300 aa, Francisella tularensis; identical to SEQ ID NO: 818

SEQ ID NO: 1226 - protein, 1306 aa, Acidaminococcus sp.
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1227 - protein, 1306 aa, synthetic construct
  REGION 1..1306: note = Synthetic sequence
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMANSNAATGEDYINSPVRDLNGVCFDSRFQNPEWPMDADANGAYHIALKGQLLLNHLKESKDLKLQNGISNQDWLAYIQELRN

SEQ ID NO: 1228 - protein, 928 aa, synthetic construct
  REGION 1..928: note = Synthetic sequence
MVQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQIELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1229 - protein, 928 aa, synthetic construct
  REGION 1..928: note = Synthetic sequence
MVQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQNELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1230 - protein, 928 aa, synthetic construct
  REGION 1..928: note = Synthetic sequence
MVQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYARGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQNELRIMAHLSRDKGLLTAFAEGKDIHRATAAEVFGLPLETVTSEQRRSAKRINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1231 - protein, 996 aa, synthetic construct; identical to SEQ ID NO: 1148
  REGION 1..996: note = Synthetic sequence

SEQ ID NO: 1232 - protein, 575 aa, synthetic construct [sequence omitted]

SEQ ID NO: 1233 - protein, 829 aa, synthetic construct
  REGION 1..829: note = Synthetic sequence
MYSICVTRSCPVVCSKKHITIGTPENPFDPNDYDFVILVGAEPFLYFAGKKGIGDYTGKRVEYNGYANWIASISPAQLHFKPEMKPVFDATVENIHDIINGREKIAKAGDYRPITDPDEAEEYIKMVYNMVIGPVAFDSETSALYCRDGYLLGVSISHQEYQGVYIDSDCLTEVAVYYLQKILDSENHTIVFHNLKFDMHFYKYHLGLTFDKAHKERRLHDTMLQHYVLDERRGTHGLKSLAMKYTDMGDYDFELDKFKDDYCKAHKIKKEDFTYDLIPFDIMWPYAAKDTDATIRLHNFFLPKIEKNEKLCSLYYDVLMPGCVFLQRVEDRGVPISIDRLKEAQYQLTHNLNKAREKLYTYPEVKQLEQDQNEAFNPNSVKQLRVLLFDYVGLTPTGKLTDTGADSTDAEALNELATQHPIAKTLLEIRKLTKLISTYVEKILLSIDADGCIRTGFHEHMTTSGRLSSSGKLNLQQLPRDESIIKGCVVAPPGYRVIAWDLTTAEVYYAAVLSGDRNMQQVFINMRNEPDKYPDFHSNIAHMVFKLQCEPRDVKKLFPALRQAAKAITFGILYGSGPAKVAHSVNEALLEQAAKTGEPFVECTVADAKEYIETYFGQFPQLKRWIDKCHDQIKNHGFIYSHFGRKRRLHNIHSEDRGVQGEEIRSGFNAIIQSASSDSLLLGAVDADNEIISLGLEQEMKIVMLVHDSVVAIVREDLIDQYNEILIRNIQKDRGISIPGCPIGIDSDSEAGGSRDYSCGKMKKQHPSIACIDDDEYTRYVKGVLLDAEFEYKKLAAMDKEHPDHSKYKDDKFIAVCKDLDNVKRILGA

SEQ ID NO: 1234 - protein, 683 aa, synthetic construct
  REGION 1..683: note = Synthetic sequence
MNERLCYDIETDGLIEEVTKLHCIAIINVDTLEEALYADSLVMMTQGTIKDGLDRLNKASLTLGHNIIKYDHPVINKLTGYELPKDKSFDTLVASRLVFSNIKDIDQGNSGKYTLGKLFGSHSLEAWGIRLGGQQKMEYAPVIDPAQPVYDPTVKPKDAKKDPRWKGSIFTPMMGDYCMQDVRVNVELFRRLERKIHQLGYARSMLLEHEAAWVLAQQERNGFKFDEEKAIKLLGRLAGRREYLYNKLIETFGGWWVSDGVSVPARTINYKDPTKPSRVQGAPFTKVKWVDFNPSSRRHIIKVLTDRGWTPQEFTPSGEAKVDESILKELDFPEARLMAEWFLVQKRLGQLADGNQAWLNTVHPDGFIRGSVNPNGAVTGRATHSFPNVAQVPSCSAEYGAECRELFTVPDGWYLLGSDASGLELRCLANFMARYDDGKYIDVVLNGDIHWSNAQAAGFIPKGTIRDPHNPIHEEARRKAKTFIYAFLYGCGAELTGQQVGWTEEEYLNWKAKGAHKPIINRFKRQGKPWTREKICNILKGEEVQKNFMKGLPALKNLIDECKELHKEQGYIEGIDGRRIYTRSAHASLNTLLQGAGALVCKAWIVEIEKLAIAEGLKHGIDGDFMYCAWVHDEVQIACRTKEIAERIGQLCQVAMTNVEKEFNFVCRLDADFDIGKSWKETH

SEQ ID NO: 1235 - protein, 1001 aa, synthetic construct
  REGION 1..1001: note = Synthetic sequence
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVIGSIVSDIEANALLESVTKFHCGVIYDYSTAEYVSYRPSDFGAYLDALEAEVARGGLIVFHNGHKYDVPALTKLAKLQLNREFHLPRENCIDTLVLSRLIHSNLKDTDMGLLRSGKLPGMLEEQGEEYVDGMEWWNFNEEMMDYNVQDVVVTKALLEKLLSDKHYFPPEIDFTDVGYTTFWSESLEAVDIEHRAAWLLAKQERNGFPFDTKAIEELYVELAARRSELLRKLTETFGSWYQPKGGTEMFCHPRTGKPLPKYPRIKTPKVGGIFKKPKNKAQREGREPCELDTREYVAGAPYTPVEHVVFNPSSRDHIQKKLQEAGWVPTKYTDKGAPVVDDEVLEGVRVDDPEKQAAIDLIKEYLMIQKRIGQSAEGDKAWLRYVAEDGKIHGSVNPNGAVTGRATHAFPNLAQIPGVRSPYGEQCRAAFGAEHHLDGITGKPWVQAGIDASGNELRCLAHFMARFDNGEYAHEILNGDIHTKNQIAAELPTRDNAKRFIYGFLYGAGDEKIGQIVGAGKERGKELKKKFLENTPAIAALRESIQQTLVESSQWVAGEQQVKWKRRWIKGLDGRKVHVRSPHAALNTLLQSAGALICKLWIIKTEEMLVEKGLKHGWDGDFAYMAWVHDEIQVGCRTEEIAQVVIETAQEAMRWVGDHWNFRCLLDTEGKMGPNWAICH

SEQ ID NO: 1236 - protein, 64 aa, Sulfolobus solfataricus
MATVKFKYKGEEKEVDISKIKKVWRVGKMISFTYDEGGGKTGRGAVSEKDAPKELLQMLEKQKK

SEQ ID NO: 1237 - protein, 740 aa, synthetic construct; identical to SEQ ID NO: 1164
  REGION 1..740: note = Synthetic sequence

SEQ ID NO: 1238 - protein, 713 aa, synthetic construct; identical to SEQ ID NO: 1168
  REGION 1..713: note = Synthetic sequence

SEQ ID NO: 1239 - protein, 870 aa, synthetic construct; identical to SEQ ID NO: 1170
  REGION 1..870: note = Synthetic sequence

SEQ ID NO: 1240 - protein, 2590 aa, synthetic construct
  REGION 1..2590: note = Synthetic sequence
MNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 1241 - protein, 900 aa, synthetic construct
  REGION 1..900: note = Synthetic sequence
MENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIPQYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQEAHQQFARNVLFQTMKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVQALELQLQVPLKVSLSAGRSWGHLVPLQEAWGPPPGPCRTESPSNSLAAPGSPASTQPPPLHFSPSFCL

SEQ ID NO: 1242 - protein, 351 aa, Escherichia coli
MRKIIHVDMDCFFAAVEMRDNPALRDIPIAIGGSRERRGVISTANYPARKFGVRSAMPTGMALKLCPHLTLLPGRFDAYKEASNHIREIFSRYTSRIEPLSLDEAYLDVTDSVHCHGSATLIAQEIRQTIFNELQLTASAGVAPVKFLAKIASDMNKPNGQFVITPAEVPAFLQTLPLAKIPGVGKVSAAKLEAMGLRTCGDVQKCDLVMLLKRFGKFGRILWERSQGIDERDVNSERLRKSVGVERTMAEDIHHWSECEAIIERLYPELERRLAKVKPDLLIARQGVKLKFDDFQQTTQEHVWPRLNKADLIATARKTWDERRGGRGVRLVGLHVTLLDPQMERQLVLGL

SEQ ID NO: 1243 - protein, 765 aa, synthetic construct
  REGION 1..765: note = Synthetic sequence
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 1244 - protein, 380 aa, synthetic construct
  REGION 1..380: note = Synthetic sequence
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 1245 - protein, 487 aa, synthetic construct
  REGION 1..487: note = Synthetic sequence
MILKILNEIASIGSTKQKQAILEKNKDNELLKRVYRLTYSRGLQYYIKKWPKPGIATQSFGMLTLTDMLDFIEFTLATRKLTGNAAIEELTGYITDGKKDDVEVLRRVMMRDLECGASVSIANKVWPGLIPEQPQMLASSYDEKGINKNIKFPAFAQLKADGARCFAEVRGDELDDVRLLSRAGNEYLGLDLLKEELIKMTAEARQIHPEGVLIDGELVYHEQVKKEPEGLDFLFDAYPENSKAKEFAEVAESRTASNGIANKSLKGTISEKEAQCMKFQVWDYVPLVEIYSLPAFRLKYDVRFSKLEQMTSGYDKVILIENQVVNNLDEAKVIYKKYIDQGLEGIILKNIDGLWENARSKNLYKFKEVIDVDLKIVGIYPHRKDPTKAGGFILESECGKIKVNAGSGLKDKAGVKSHELDRTRIMENQNYYIGKILECECNGWLKSDGRTDYVKLFLPIAIRLREDKTKANTFEDVFGDFHEVTGL

SEQ ID NO: 1246 - protein, 927 aa, Escherichia coli
VQIPQNPLILVDGSSYLYRAYHAFPPLTNSAGEPTGAMYGVLNMLRSLIMQYKPTHAAVVFDAKGKTFRDELFEHYKSHRPPMPDDLRAQIEPLHAMVKAMGLPLLAVSGVEADDVIGTLAREAEKAGRPVLISTGDKDMAQLVTPNITLINTMTNTILGPEEVVNKYGVPPELIIDFLALMGDSSDNIPGVPGVGEKTAQALLQGLGGLDTLYAEPEKIAGLSFRGAKTMAAKLEQNKEVAYLSYQLATIKTDVELELTCEQLEVQQPAAEELLGLFKKYEFKRWTADVEAGKWLQAKGAKPAAKPQETSVADEAPEVTATVISYDNYVTILDEETLKAWIAKLEKAPVFAFDTETDSLDNISANLVGLSFAIEPGVAAYIPVAHDYLDAPDQISRERALELLKPLLEDEKALKVGQNLKYDRGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQIELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 1247 - protein, 167 aa, synthetic construct
  REGION 1..167: note = Synthetic sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 1248 - protein, 178 aa, synthetic construct
  REGION 1..178: note = Synthetic sequence
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

What is claimed is:

1. A cell comprising:
   a) an enzymatically active RNA-guided endonuclease that introduces a break in at least one strand in a target DNA;
   b) a DNA polymerase that binds to the target DNA 5' to the break; and
   c) a guide RNA that binds the endonuclease,
   wherein neither said endonuclease nor said polymerase comprises a deaminase.

2. The cell of claim 1, wherein the cell is a prokaryotic cell.

3. The cell of claim 1, wherein the cell is a eukaryotic cell.

4. The cell of claim 1, wherein the cell is in vitro.

5. The cell of claim 1, wherein the guide RNA comprises a protein-binding segment comprising a nucleotide sequence that binds to the endonuclease, and a target-binding segment comprising a nucleotide sequence that is complementary to a target nucleotide sequence of the target DNA.

6. The cell of claim 1, wherein the guide RNA comprises one or more of:
   a) a modified base;
   b) a modified backbone;
   c) a modified sugar moiety;
   d) a non-natural internucleoside linkage.

7. The cell of claim 1, wherein the guide RNA guides the endonuclease to introduce the break in the target DNA.

8. The cell of claim 1, wherein the break in at least one strand is a single-stranded break.

9. The cell of claim 1, wherein the DNA polymerase synthesizes a new strand on the target DNA.

10. The cell of claim 9, wherein the DNA polymerase introduces a mutation in the new strand.

11. The cell of claim 10, wherein the DNA polymerase introduces a mutation in the new strand at a distance of from 1 nucleotide to 100 nucleotides from the single-stranded break in the target DNA.

12. The cell of claim 1, wherein the endonuclease comprises a class 2 CRISPR/Cas endonuclease.

13. The cell of claim 12, wherein the class 2 CRISPR/Cas endonuclease comprises a type V or type VI CRISPR/Cas endonuclease.

14. The cell of claim 12, wherein the class 2 CRISPR/Cas endonuclease comprises a Cas9 polypeptide.

15. The cell of claim 1, wherein the endonuclease and the DNA polymerase are fused as parts of a fusion polypeptide.

16. The cell of claim 15, wherein the fusion polypeptide, when complexed with a guide RNA, exhibits a target mutation rate of from $10^{-8}$ to $10^{-7}$, $10^{-7}$ to $10^{-6}$, $10^{-6}$ to $10^{-5}$, $10^{-5}$ to $10^{4}$, $10^{4}$ to $10^{3}$, or $10^{3}$ to $10^{-2}$ mutations per nucleotide per genome replication event.

17. The cell of claim 15, wherein the fusion polypeptide further comprises a linker connecting the endonuclease and the DNA polymerase.

18. The cell of claim 15, wherein the fusion polypeptide further comprises a nuclear localization signal.

19. The cell of claim 15, wherein the fusion polypeptide comprises, in order from N-terminus to C-terminus:
a) the enzymatically active RNA-guided endonuclease; and
b) the DNA polymerase.

20. The cell of claim 15, wherein the fusion polypeptide comprises, in order from N-terminus to C-terminus:
a) the enzymatically active RNA-guided endonuclease;
b) a linker; and
c) the DNA polymerase.

21. The cell of claim 15, wherein the fusion polypeptide comprises, in order from N-terminus to C-terminus:
a) a nuclear localization signal;
b) the enzymatically active RNA-guided endonuclease; and
c) the DNA polymerase.

22. The cell of claim 15, wherein the fusion polypeptide comprises, in order from N-terminus to C-terminus:
a) a nuclear localization signal;
b) the enzymatically active RNA-guided endonuclease;
c) a linker; and
d) the DNA polymerase.

23. The cell of claim 15, wherein the fusion polypeptide comprises, in order from N-terminus to C-terminus:
a) the DNA polymerase; and
b) the enzymatically active RNA-guided endonuclease.

24. The cell of claim 15, wherein the fusion polypeptide comprises, in order from N-terminus to C-terminus:
a) the DNA polymerase;
b) a linker; and
c) the enzymatically active RNA-guided endonuclease.

25. The cell of claim 15, wherein the fusion polypeptide comprises, in order from N-terminus to C-terminus:
a) a nuclear localization signal;
b) the DNA polymerase; and
c) the enzymatically active RNA-guided endonuclease.

26. The cell of claim 15, wherein the fusion polypeptide comprises, in order from N-terminus to C-terminus:
a) a nuclear localization signal;
b) the DNA polymerase;
c) a linker; and
d) the enzymatically active RNA-guided endonuclease.

27. The cell of claim 1, wherein the cell is in vivo.

* * * * *